US012760302B2

(12) United States Patent
Abe et al.

(10) Patent No.: US 12,760,302 B2
(45) **Date of Patent: *Oct. 13, 2026**

(54) POLYNUCLEOTIDE AND PHARMACEUTICAL COMPOSITION

(71) Applicants: National University Corporation Tokai National Higher Education and Research System, Aichi (JP); Kyowa Kirin Co., Ltd., Tokyo (JP)

(72) Inventors: Hiroshi Abe, Aichi (JP); Hiroto Iwai, Tokyo (JP); Masakazu Homma, Tokyo (JP); Kana Asano, Tokyo (JP); Kenji Harada, Tokyo (JP); Junichiro Yamamoto, Tokyo (JP); Fumikazu Shinohara, Tokyo (JP); Keiichi Motosawa, Tokyo (JP); Yasuaki Kimura, Aichi (JP); Kosuke Nakamoto, Aichi (JP)

(73) Assignees: NATIONAL UNIVERSITY CORPORATION TOKAI NATIONAL HIGHER EDUCATION AND RESEARCH SYSTEM, Aichi (JP); KYOWA KIRIN CO., LTD., Tokyo (JP)

( * ) Notice: Subject to any disclaimer, the term of this patent is extended or adjusted under 35 U.S.C. 154(b) by 993 days.

This patent is subject to a terminal disclaimer.

(21) Appl. No.: 17/789,040

(22) PCT Filed: Dec. 25, 2020

(86) PCT No.: PCT/JP2020/048799

§ 371 (c)(1),
(2) Date: Jun. 24, 2022

(87) PCT Pub. No.: WO2021/132589

PCT Pub. Date: Jul. 1, 2021

(65) Prior Publication Data

US 2023/0073999 A1 Mar. 9, 2023

(30) Foreign Application Priority Data

Dec. 26, 2019 (JP) ................................ 2019-236399

(51) Int. Cl.
*C12N 15/11* (2006.01)

(52) U.S. Cl.
CPC ........ *C12N 15/11* (2013.01); *C12N 2310/315* (2013.01); *C12N 2310/32* (2013.01); *C12N 2310/33* (2013.01); *C12N 2830/50* (2013.01)

(58) Field of Classification Search
CPC .............. C12N 15/11; C12N 2310/315; C12N 2310/32; C12N 2310/33; C12N 2830/50; C07H 21/02; A61K 48/00; A61P 43/00
See application file for complete search history.

(56) References Cited

U.S. PATENT DOCUMENTS

2014/0010861 A1 1/2014 Bancel et al.
2016/0022840 A1* 1/2016 Chakraborty ........ A61K 38/193 536/23.1

FOREIGN PATENT DOCUMENTS

WO 2014/093574 6/2014

OTHER PUBLICATIONS

Kore et al. "Synthesis and evaluation of 2'-O-allyl substituted dinucleotide cap analog for mRNA translation" Bioorganic & Medicinal Chemistry 18, (2010) 8061-8065. (Year: 2010).*

(Continued)

*Primary Examiner* — Jezia Riley
(74) *Attorney, Agent, or Firm* — Wenderoth, Lind & Ponack, L.L.P.

(57) ABSTRACT

An object of the present invention is to provide a polynucleotide having a modification site in a translated region with translation activity retained. The object can be achieved by a polynucleotide containing a translated region from a start codon to a stop codon, in which the translated region (Continued)

contains n codons, and the n is a positive integer of 2 or more, each of the n codons contains first, second and third nucleotides, and the first nucleotides in at least two codons of the n codons are sugar modified nucleotides.

25 Claims, 2 Drawing Sheets

Specification includes a Sequence Listing.

(56) References Cited

OTHER PUBLICATIONS

Hofler, S. et al., "Structural and functional roles of 2'-O-ribose methylations and their enzymatic machinery across multiple classes of RNAs", Current Opinion In Structural Biology, 2020, vol. 65, pp. 42-50.
Das, G. et al., "Influence of Sugar Modifications on the Nucleoside Conformation and Oligonucleotide Stability: A Critical Review", Chemical Record, 2022, vol. 22, e202200174, 27 pages.
Li, Y. et al., "2'- and -3'-Ribose Modifications of Nucleotide Analogues Establish the Structural Basis to Inhibit the Viral Replication of SARS-CoV-2", J. Physical Chemistry Letter, 2022, vol. 13, No. 18, pp. 4111-4118.
Sahin, Ugur et al., "mRNA-based therapeutics—developing a new class of drugs", Nature Reviews Drug Discovery, 2014, vol. 13, pp. 759-780.
Khvorova, Anastasia et al., "The chemical evolution of oligonucleotide therapies of clinical utility", Nature Biotechnology, 2017, vol. 35. No. 3, pp. 238-248.
Watts, Jonathan K. et al., "Chemically modified siRNA: tools and applications", Drug Discovery Today, 2008, vol. 13, No. 19/20, pp. 842-855.
DeFrancesco, Laura, "The anti-hype vaccine", Nature Biotechnology, Mar. 2017, vol. 35, No. 3, pp. 193-197.
Sahin, Ugur et al., "Personalized RNA mutanome vaccines mobilize poly-specific therapeutic immunity against cancer", Nature, 2017, vol. 547, No. 7662, pp. 222-226.
Hoernes, Thomas Philipp et al., "Nucleotide modifications within bacterial messenger RNAs regulate their translation and are able to rewire the genetic code", Nucleic Acids Research, 2016, vol. 44, No. 2, pp. 852-862.
Hoernes, Thomas Philipp et al., "Eukaryotic Translation Elongation is Modulated by Single Natural Nucleotide Derivatives in the Coding Sequences of mRNAs", Genes, 2019, vol. 10, No. 84, 12 pages.
International Search Report and Written Opinion, issuing in PCT/JP2020/048799 on Feb. 22, 2021.
Nakamoto, Margaret A. et al., "mRNA pseudouridylation affects RNA metabolism in the parasite *Toxoplasma gondii*", RNA, 2017, vol. 23, pp. 1834-1849.
Office Action issued Dec. 3, 2024 in Japanese Application No. 2021-567685 (with English translation).
Office Action issued Nov. 11, 2024 in Taiwanese Application No. 109146310 (with English translation).
Monia et al., "Evaluation of 2'-Modified Oligonucleotides Containing 2'-Deoxy Gaps as Antisense Inhibitors of Gene Expression", The Journal of Biological Chemistry, 1993, vol. 268, No. 19, pp. 14514-14522.
Office Action issued May 25, 2026 in Canadian Patent Application No. 3,165,956.

* cited by examiner

POLYNUCLEOTIDE AND PHARMACEUTICAL COMPOSITION

TECHNICAL FIELD

The present invention relates to a polynucleotide and a pharmaceutical composition containing the polynucleotide.

BACKGROUND ART

Genetic information in a cell is transferred by transcribing a messenger RNA (hereinafter also referred to as an "mRNA") by an RNA synthetic enzyme with a DNA used as a template, and by synthesizing a protein through translation by causing a ribosome to bind to the transcribed single-stranded mRNA. This transfer method is designated as "central dogma" in molecular biology, and is a basic principle common to both prokaryotes and eukaryotes.

An mRNA working as an intermediate in the genetic information transfer has base sequence information and structure directly recognized by a ribosome to be translated into a protein.

In recent years, a nucleic acid medicine is expected more and more as a next generation medicament. A polynucleotide used as an mRNA (hereinafter also referred to as an "artificial mRNA") can be used as a nucleic acid medicine for protein replacement therapy through expression increase or expression acceleration, or a nucleic acid medicine for vaccine therapy through peptide expression.

It is, however, known that an artificial mRNA containing natural bases alone externally introduced into a cell binds to a Toll-like receptor (such as TLR3, TLR7, TLR8, or RIG-I) in the cell to rapidly cause an immune response, and cause an inflammatory reaction and decrease of protein translation level (Non Patent Literature 1). In order to express the protein in the cell, it is necessary to somehow reduce the immunoreactivity of the artificial mRNA itself, and at the same time, to prevent the decrease of the translation level. Besides, since an RNA containing natural bases alone is fragile against a nuclease, it is deemed that a modified nucleotide needs to be introduced also from the viewpoint of imparting stability (Non Patent Literature 2). It is described that a polynucleotide containing a sugar modified nucleotide such as a 2'-O-methylated RNA, a 2'-F modified RNA, or a locked nucleic acid among modified nucleotides is effective for both the decrease of the immunoreactivity of a nucleic acid medicine and the impartment of resistance against a nuclease (Non Patent Literature 3).

In recent years, movement to use an mRNA artificially synthesized in a test tube by in vitro transcription (hereinafter referred to as "IVT") as a medicament has been actively promoted (Non Patent Literature 4).

For example, as reported in Non Patent Literature 5 that incidence of metastasis is greatly decreased in a clinical test of an artificial mRNA cancer vaccine on melanoma patients after administration of the cancer vaccine is started, given positive results have been reported.

The artificial mRNA thus clinically applied, however, is produced by IVT. The artificial mRNA produced by IVT has the following two problems. First, an introduction position of a modified nucleotide to be introduced for the purpose of the decrease of the immunoreactivity and the impartment of stability against a nuclease cannot be controlled. Patent Literature 1 discloses a case in which peptide translation potential is weakened/lost in an artificial mRNA having a 2'-F modified RNA introduced therein by IVT. Secondly, it is impossible to introduce a modified nucleotide unless it is recognized as a substrate by an RNA synthetic enzyme used in IVT. Patent Literature 1 also discloses that it is difficult to prepare an artificial mRNA containing a 2'-O-methylated modified RNA through an IVT reaction using a general RNA polymerase.

Accordingly, an artificial mRNA produced by introducing a modified nucleotide by IVT has not been completely studied in the position and type of the modified nucleotide.

A method for artificially synthesizing an mRNA by a technique for chemically ligating a plurality of RNAs has been reported (Non Patent Literatures 6 and 7). When this method is employed, a modified nucleotide including sugar modification can be introduced into an optional position in an artificial mRNA containing a coding sequence (hereinafter also referred to as a "CDS"). Actually, Non Patent Literatures 6 and 7 disclose that an artificial mRNA was produced by introducing a 2'-O-methylated modified RNA into one position in a CDS of an mRNA, and that peptide translation potential of the resultant was found. On the other hand, it is also disclosed that the peptide translation potential is largely weakened depending on the introduction position of the sugar modified nucleotide, and therefore, in order to realize sufficiently low immunoreactivity and high stability as a nucleic acid medicine, further knowledge about a modification rate, position and type of a modified nucleotide is required.

CITATION LIST

Patent Literature

Patent Literature 1: International Publication No. WO2014/093574

Non Patent Literature

Non Patent Literature 1: Nature Reviews Drug Discovery, Vol. 13, p. 759-780 (2014)
Non Patent Literature 2: Nature Biotechnology, Vol. 35, No. 3, p. 238-248 (2017)
Non Patent Literature 3: Drug Discovery Today, Vol. 13, No. 19/20, p. 842-855 (2008)
Non Patent Literature 4: Nature Biotechnology, Vol. 35, No. 3, p. 193-197 (2017)
Non Patent Literature 5: Nature, Vol. 547, No. 7662, p. 222-226 (2017)
Non Patent Literature 6: Nucleic Acids Research, Vol. 44, No. 2, p. 852-862 (2015)
Non Patent Literature 7: Genes, Vol. 10, No. 2, p. 84 (2019)

SUMMARY OF INVENTION

Technical Problem

An object of the present invention is to provide a polynucleotide having a modification site in a translated region with translation activity retained.

Solution to Problem

The present inventors made earnest studies resulting in finding that among first, second and third nucleotides contained in each of a plurality of codons contained in a translated region, even when a sugar portion of the first nucleotide is modified, translation activity is retained.

The present invention encompasses the following embodiments:

[1]

A polynucleotide comprising a translated region from a start codon to a stop codon, wherein the translated region contains n codons, and the n is a positive integer of 2 or more, each of the n codons contains first, second and third nucleotides, and the first nucleotides in at least two codons of the n codons are sugar modified nucleotides.

[2]

The polynucleotide according to [1], wherein the sugar modified nucleotides each contain a sugar portion modified at least in the 2' position.

[3]

The polynucleotide according to [2], wherein the sugar portion modified at least in the 2' position is selected from the following:

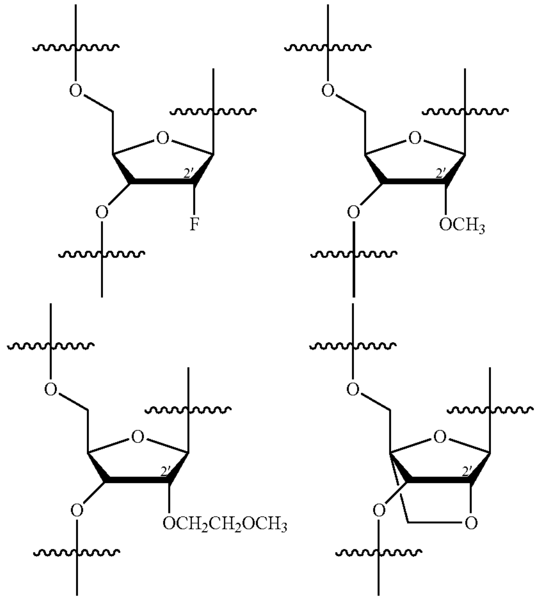

[4]

The polynucleotide according to any one of [1] to [3], wherein the sugar modified nucleotides each contain a base portion corresponding to a base selected from the group consisting of adenine, guanine, cytosine, and uracil, and the number of types of the base is at least two.

[5]

The polynucleotide according to any one of [1] to [4], wherein at least one of the sugar modified nucleotides contains a modified base portion.

[6]

The polynucleotide according to any one of [1] to [5], wherein the first nucleotides in all the n codons are sugar modified nucleotides.

[6-1]

The polynucleotide according to any one of [1] to [5], in which a ratio that first nucleotides in the n codons are sugar modified nucleotides is 5% or more.

[6-2]

The polynucleotide according to any one of [1] to [5], in which a ratio that first nucleotides in the n codons are sugar modified nucleotides is 10% or more.

[6-3]

The polynucleotide according to any one of [1] to [5], in which a ratio that first nucleotides in the n codons are sugar modified nucleotides is 15% or more.

[6-4]

The polynucleotide according to any one of [1] to [5], in which a ratio that first nucleotides in the n codons are sugar modified nucleotides is 20% or more.

[6-5]

The polynucleotide according to any one of [1] to [5], in which a ratio that first nucleotides in the n codons are sugar modified nucleotides is 25% or more.

[6-6]

The polynucleotide according to any one of [1] to [5], in which a ratio that first nucleotides in the n codons are sugar modified nucleotides is 30% or more.

[6-7]

The polynucleotide according to any one of [1] to [5], in which a ratio that first nucleotides in the n codons are sugar modified nucleotides is 35% or more.

[6-8]

The polynucleotide according to any one of [1] to [5], in which a ratio that first nucleotides in the n codons are sugar modified nucleotides is 40% or more.

[6-9]

The polynucleotide according to any one of [1] to [5], in which a ratio that first nucleotides in the n codons are sugar modified nucleotides is 45% or more.

[6-10]

The polynucleotide according to any one of [1] to [5], in which a ratio that first nucleotides in the n codons are sugar modified nucleotides is 50% or more.

[6-11]

The polynucleotide according to any one of [1] to [5], in which a ratio that first nucleotides in the n codons are sugar modified nucleotides is 55% or more.

[6-12]

The polynucleotide according to any one of [1] to [5], in which a ratio that first nucleotides in the n codons are sugar modified nucleotides is 60% or more.

[6-13]

The polynucleotide according to any one of [1] to [5], in which a ratio that first nucleotides in the n codons are sugar modified nucleotides is 65% or more.

[6-14]

The polynucleotide according to any one of [1] to [5], in which a ratio that first nucleotides in the n codons are sugar modified nucleotides is 70% or more.

[6-15]

The polynucleotide according to any one of [1] to [5], in which a ratio that first nucleotides in the n codons are sugar modified nucleotides is 75% or more.

[6-16]

The polynucleotide according to any one of [1] to [5], in which a ratio that first nucleotides in the n codons are sugar modified nucleotides is 80% or more.

[6-17]

The polynucleotide according to any one of [1] to [5], in which a ratio that first nucleotides in the n codons are sugar modified nucleotides is 90% or more.

[6-18]

The polynucleotide according to any one of [1] to [5], in which a ratio that first nucleotides in the n codons are sugar modified nucleotides is 95% or more.

[7]

The polynucleotide according to any one of [1] to [6-18], wherein the first, second and third nucleotides in the stop codon are sugar modified nucleotides.

[8]

The polynucleotide according to any one of [1] to [7], wherein the first, second and third nucleotides in the start codon are sugar modified nucleotides.

[9]

The polynucleotide according to any one of [1] to [8], wherein the second nucleotide in at least one codon of the n codons is a sugar modified nucleotide.

[9-1]

The polynucleotide according to any one of [1] to [9], in which a ratio that second nucleotides in the n codons are sugar modified nucleotides is 50% or less.

[9-2]

The polynucleotide according to any one of [1] to [9], in which a ratio that second nucleotides in the n codons are sugar modified nucleotides is 45% or less.

[9-3]

The polynucleotide according to any one of [1] to [9], in which a ratio that second nucleotides in the n codons are sugar modified nucleotides is 40% or less.

[9-4]

The polynucleotide according to any one of [1] to [9], in which a ratio that second nucleotides in the n codons are sugar modified nucleotides is 35% or less.

[9-5]

The polynucleotide according to any one of [1] to [9], in which a ratio that second nucleotides in the n codons are sugar modified nucleotides is 30% or less.

[9-6]

The polynucleotide according to any one of [1] to [9], in which a ratio that second nucleotides in the n codons are sugar modified nucleotides is 25% or less.

[9-7]

The polynucleotide according to any one of [1] to [9], in which a ratio that second nucleotides in the n codons are sugar modified nucleotides is 20% or less.

[9-8]

The polynucleotide according to any one of [1] to [9], in which a ratio that second nucleotides in the n codons are sugar modified nucleotides is 15% or less.

[9-9]

The polynucleotide according to any one of [1] to [9], in which a ratio that second nucleotides in the n codons are sugar modified nucleotides is 10% or less.

[9-10]

The polynucleotide according to any one of [1] to [9], in which a ratio that second nucleotides in the n codons are sugar modified nucleotides is 5% or less.

[9-11]

The polynucleotide according to any one of [1] to [6-18], in which a ratio that second nucleotides in the n codons are sugar modified nucleotides is 0%.

[10]

The polynucleotide according to any one of [1] to [9-11], wherein the third nucleotide in at least one codon of the n codons is a sugar modified nucleotide.

[10-1]

The polynucleotide according to any one of [1] to [10], in which a ratio that third nucleotides in the n codons are sugar modified nucleotides is 100%.

[10-2]

The polynucleotide according to any one of [1] to [10], in which a ratio that third nucleotides in the n codons are sugar modified nucleotides is 90% or less.

[10-3]

The polynucleotide according to any one of [1] to [10], in which a ratio that third nucleotides in the n codons are sugar modified nucleotides is 80% or less.

[10-4]

The polynucleotide according to any one of [1] to [10], in which a ratio that third nucleotides in the n codons are sugar modified nucleotides is 70% or less.

[10-5]

The polynucleotide according to any one of [1] to [10], in which a ratio that third nucleotides in the n codons are sugar modified nucleotides is 60% or less.

[10-6]

The polynucleotide according to any one of [1] to [10], in which a ratio that third nucleotides in the n codons are sugar modified nucleotides is 50% or less.

[10-7]

The polynucleotide according to any one of [1] to [10], in which a ratio that third nucleotides in the n codons are sugar modified nucleotides is 45% or less.

[10-8]

The polynucleotide according to any one of [1] to [10], in which a ratio that third nucleotides in the n codons are sugar modified nucleotides is 40% or less.

[10-9]

The polynucleotide according to any one of [1] to [10], in which a ratio that third nucleotides in the n codons are sugar modified nucleotides is 35% or less.

[10-10]

The polynucleotide according to any one of [1] to [10], in which a ratio that third nucleotides in the n codons are sugar modified nucleotides is 30% or less.

[10-11]

The polynucleotide according to any one of [1] to [10], in which a ratio that third nucleotides in the n codons are sugar modified nucleotides is 25% or less.

[10-12]

The polynucleotide according to any one of [1] to [10], in which a ratio that third nucleotides in the n codons are sugar modified nucleotides is 20% or less.

[10-13]

The polynucleotide according to any one of [1] to [10], in which a ratio that third nucleotides in the n codons are sugar modified nucleotides is 15% or less.

[10-14]

The polynucleotide according to any one of [1] to [10], in which a ratio that third nucleotides in the n codons are sugar modified nucleotides is 10% or less.

[10-15]

The polynucleotide according to any one of [1] to [10], in which a ratio that third nucleotides in the n codons are sugar modified nucleotides is 5% or less.

[10-16]

The polynucleotide according to any one of [1] to [6-18] and [9] to [9-11], in which a ratio that third nucleotides in the n codons are sugar modified nucleotides is 0%.

[11]

The polynucleotide according to any one of [1] to [10-16], wherein the n is an integer of 2 to 2000.

[11-1]

The polynucleotide according to any one of [1] to [10-16], wherein the n is an integer of 2 to 1500.

[11-2]

The polynucleotide according to any one of [1] to [10-16], wherein the n is an integer of 2 to 1000.

[11-3]

The polynucleotide according to any one of [1] to [10-16], wherein the n is an integer of 2 to 500.

[11-4]

The polynucleotide according to any one of [1] to [10-16], wherein the n is an integer of 5 to 2000.

[11-5]

The polynucleotide according to any one of [1] to [10-16], wherein the n is an integer of 5 to 1500.

[11-6]

The polynucleotide according to any one of [1] to [10-16], wherein the n is an integer of 5 to 1000.

[11-7]

The polynucleotide according to any one of [1] to [10-16], wherein the n is an integer of 5 to 500.

[11-8]

The polynucleotide according to any one of [1] to [10-16], wherein the n is an integer of 10 to 2000.

[11-9]

The polynucleotide according to any one of [1] to [10-16], wherein the n is an integer of 10 to 1500.

[11-10]

The polynucleotide according to any one of [1] to [10-16], wherein the n is an integer of 10 to 1000.

[11-11]

The polynucleotide according to any one of [1] to [10-16], wherein the n is an integer of 10 to 500.

[11-12]

The polynucleotide according to any one of [1] to [10-16], wherein the n is an integer of 50 to 2000.

[11-13]

The polynucleotide according to any one of [1] to [10-16], wherein the n is an integer of 50 to 1500.

[11-14]

The polynucleotide according to any one of [1] to [10-16], wherein the n is an integer of 50 to 1000.

[11-15]

The polynucleotide according to any one of [1] to [10-16], wherein the n is an integer of 50 to 500.

[11-16]

The polynucleotide according to any one of [1] to [10-16], wherein the n is an integer of 100 to 2000.

[11-17]

The polynucleotide according to any one of [1] to [10-16], wherein the n is an integer of 100 to 1500.

[11-18]

The polynucleotide according to any one of [1] to [10-16], wherein the n is an integer of 100 to 1000.

[11-19]

The polynucleotide according to any one of [1] to [10-16], wherein the n is an integer of 100 to 500.

[11-20]

The polynucleotide according to any one of [1] to [10-16], wherein the n is an integer of 200 to 2000.

[11-21]

The polynucleotide according to any one of [1] to [10-16], wherein the n is an integer of 200 to 1500.

[11-22]

The polynucleotide according to any one of [1] to [10-16], wherein the n is an integer of 200 to 1000.

[11-23]

The polynucleotide according to any one of [1] to [10-16], wherein the n is an integer of 200 to 500.

The polynucleotide according to any one of [1] to [11-23], further comprising a 5' untranslated region.

[13]

The polynucleotide according to [12], wherein the 5' untranslated region contains a base modified nucleotide containing the following base portion:

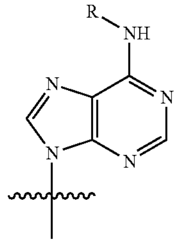

wherein R is an alkyl group having 1 to 6 carbon atoms.

[14]

The polynucleotide according to [12] or [13], wherein first, second, and third nucleotides from a 5' end of the 5' untranslated region are sugar modified nucleotides.

The polynucleotide according to any one of [12] to [14], further comprising a 5' cap structure.

The polynucleotide according to any one of [1] to [15], further comprising a 3' untranslated region.

The polynucleotide according to [16], wherein the 3' untranslated region contains a poly A chain.

[18]

The polynucleotide according to [16] or [17], wherein first, second, and third nucleotides from a 3' end of the 3' untranslated region are sugar modified nucleotides.

[19]

The polynucleotide according to any one of [12] to [18], wherein the 5' untranslated region and/or the 3' untranslated region contains a sugar modified nucleotide.

[20]

The polynucleotide according to any one of [1] to [19], comprising the following structure:

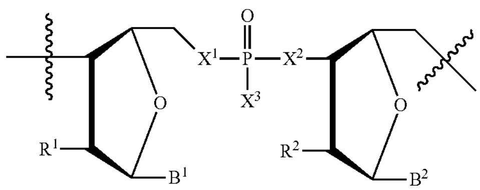

wherein $R^1$ and $R^2$ each independently represent H, OH, F or $OCH_3$, $B^1$ and $B^2$ each independently represent a base portion, $X^1$ represents O, S or NH, and $X^2$ represents O, S, NH or the following structure:

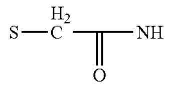

wherein $X^3$ represents OH, SH or a salt thereof, and $X^1$ and $X^2$ are not simultaneously O.

[21]

The polynucleotide according to any one of claims [1] to [20], comprising a phosphorothioate structure.

[22]

The polynucleotide according to any one of [1] to [21], wherein the first nucleotide and the second nucleotide in at least one codon of the n codons are linked to each other via phosphorothioate.

[23]

The polynucleotide according to any one of [1] to [22], wherein first to second nucleotides, first to third nucleotides, first to fourth nucleotides, or first to fifth nucleotides from the 5' end of the 5' untranslated region are linked to one another via phosphorothioate.

[24]

The polynucleotide according to any one of [1] to [23], wherein first to second nucleotides, first to third nucleotides, first to fourth nucleotides, or first to fifth nucleotides from the 3' end of the 3' untranslated region are linked to one another via phosphorothioate.

[25]

A pharmaceutical composition comprising the polynucleotide according to any one of [1] to [24].

The present invention further encompasses the following embodiments:

[1A]

The polynucleotide according to any one of [1] to [24], or the pharmaceutical composition according to [25], for use in treatment of a disease.

[1B]

A method for treating a disease, including administering a therapeutically effective amount of the polynucleotide according to any one of [1] to [24] or the pharmaceutical composition according to [25] to a patient in need thereof.

[1C]

Use of the polynucleotide according to any one of [1] to [24] or the pharmaceutical composition according to [25] for treating a disease.

[1D]

Use of the polynucleotide according to any one of [1] to [24] in production of a medicament for treating a disease.

[1E]

The polynucleotide according to any one of [1] to [24], for use in production of a medicament for treating a disease.

[1F]

A kit for use in treatment of a disease, including the polynucleotide according to any one of [1] to [24] or the pharmaceutical composition according to [25], and an instruction manual.

The present invention further encompasses the following embodiments:

[2A]

A polynucleotide, including a translated region, and a 5' untranslated region, in which first, second and third nucleotides from the 5' end of the 5' untranslated region are sugar modified nucleotides.

[2B]

A polynucleotide, including a translated region, and a 3' untranslated region, in which first, second and third nucleotides from the 3' end of the 3' untranslated region are sugar modified nucleotides.

[2C]

A polynucleotide, including a translated region, a 5' untranslated region, and 3' untranslated region, in which first, second and third nucleotides from the 5' end of the 5' untranslated region are sugar modified nucleotides, and first, second and third nucleotides from the 3' end of the 3' untranslated region are sugar modified nucleotides.

[2D]

A polynucleotide, including a translated region, and a 5' untranslated region, in which first to third nucleotides, first to fourth nucleotides, or first to fifth nucleotides from the 5' end of the 5' untranslated region are linked to one another via phosphorothioate.

[2E]

A polynucleotide, including a translated region, and a 3' untranslated region, in which first to third nucleotides, first to fourth nucleotides, or first to fifth nucleotides from the 3' end of the 3' untranslated region are linked to one another via phosphorothioate.

[2F]

A polynucleotide, including a translated region, a 5' untranslated region, and a 3' untranslated region, in which first to third nucleotides, first to fourth nucleotides, or first to fifth nucleotides from the 5' end of the 5' untranslated region are linked to one another via phosphorothioate, and first to third nucleotides, first to fourth nucleotides, or first to fifth nucleotides from the 3' end of the 3' untranslated region are linked to one another via phosphorothioate.

[2G]

A polynucleotide, including a translated region, and a 5' untranslated region, in which first, second, and third nucleotides from the 5' end of the 5' untranslated region are sugar modified nucleotides, and first to third nucleotides, first to fourth nucleotides, or first to fifth nucleotides from the 5' end of the 5' untranslated region are linked to one another via phosphorothioate.

[2H]

A polynucleotide, including a translated region, and a 3' untranslated region, in which first, second, and third nucleotides from the 3' end of the 3' untranslated region are sugar modified nucleotides, and first to third nucleotides, first to fourth nucleotides, or first to fifth nucleotides from the 3' end of the 3' untranslated region are linked to one another via phosphorothioate.

A polynucleotide, including a translated region, a 5' untranslated region, and a 3' untranslated region, in which first, second, and third nucleotides from the 5' end of the 5' untranslated region are sugar modified nucleotides, first to third nucleotides, first to fourth nucleotides, or first to fifth nucleotides from the 5' end of the 5' untranslated region are linked to one another via phosphorothioate, first, second, and third nucleotides from the 3' end of the 3' untranslated region are sugar modified nucleotides, and first to third nucleotides, first to fourth nucleotides, or first to fifth nucleotides from the 3' end of the 3' untranslated region are linked to one another via phosphorothioate.

Advantageous Effects of Invention

According to the present invention, a polynucleotide having a modification site in a translated region with translation activity retained can be provided.

DESCRIPTION OF EMBODIMENTS

<Polynucleotide>

One embodiment of the present invention relates to a polynucleotide containing a translated region from a start codon to a stop codon, in which the translated region contains n codons, the n is a positive integer of 2 or more, each of the n codons contains first, second and third nucleotides, and the first nucleotides in at least two codons of the n codons are sugar modified nucleotides.

Figure 1:
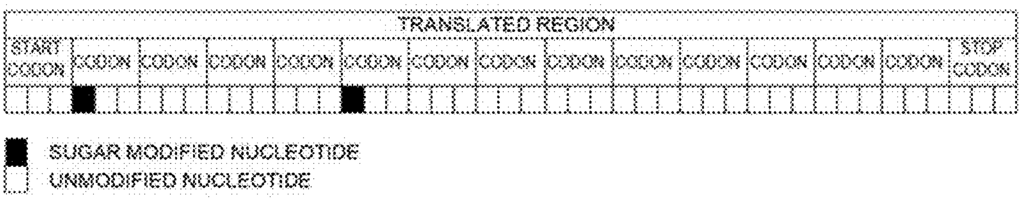
FIG. 1 is a schematic diagram of a translated region in which first nucleotides in two codons are sugar modified nucleotides.

FIG. 1 is a schematic diagram of a translated region in which first nucleotides in optional two codons are sugar modified nucleotides.

Since translation activity is retained even when a sugar portion of the first nucleotide in a plurality of codons contained in the translated region is modified, the polynucleotide of the present embodiment has a modification site in the translated region with the translation activity retained. Herein, the term "translation activity" means activity of translating an mRNA to synthesize a polypeptide (the term "polypeptide" used herein encompasses a protein). The polynucleotide of the present embodiment also has excellent stability against an enzyme (such as nuclease).

Herein, the term "with translation activity retained" refers to that the polynucleotide modified in the sugar portion of the first nucleotide in the plurality of codons has translation activity corresponding to 60% or more of that of an unmodified polynucleotide. The translation activity of the modified polynucleotide is preferably 70% or more, 80% or more, 90% or more, or 100% or more as compared with that of the unmodified polynucleotide.

The polynucleotide of the present embodiment is understood as a polynucleotide having an equivalent function to, for example, an mRNA, a small open reading frame (smORF), a non-canonical open reading frame, a long noncoding RNA (lncRNA), or a pri-microRNA (pri-miRNA) in that the translated region is translated into a polypeptide.

(Translated Region)

The polynucleotide of the present embodiment contains the translated region. The translated region is also designated as a coding sequence (CDS). One polynucleotide may contain a plurality of translated regions. The translated region contains a plurality of codons from a start codon to a stop codon (or designated as a termination codon), and is a region to be translated to synthesize a polypeptide. A codon is a unit encoding each amino acid contained in a polypeptide, and the unit includes three nucleotides.

Although not limited to a natural codon table, based on the natural codon table, a start codon can be, for example, AUG encoding methionine. Examples of an unusual start codon excluding AUG include CUG, GUG, UUG, ACG, AUC, AUU, AAG, AUA, and AGG. Examples of a stop codon include UAA, UAG and UGA. The types of codons contained in the translated region are not especially limited, and can be appropriately selected in accordance with a target polypeptide.

The number (n) of the codons contained in the translated region is preferably an integer of 2 to 2000, more preferably an integer of 2 to 1500, further preferably an integer of 2 to 1000, and most preferably an integer of 2 to 500. Alternatively, the lower limit of these numerical ranges may be changed to 5, 10, 50, 100, 200 or the like. When the lower limit is changed, the number (n) of the codons contained in the translated region is preferably an integer of 5 to 2000, 10 to 2000, 50 to 2000, 100 to 2000, or 200 to 2000, more preferably an integer of 5 to 1500, 10 to 1500, 50 to 1500, 100 to 1500, or 200 to 1500, further preferably an integer of 5 to 1000, 10 to 1000, 50 to 1000, 100 to 1000, or 200 to 1000, and most preferably an integer of 5 to 500, 10 to 500, 50 to 500, 100 to 500, or 200 to 500.

Each codon contains first, second and third nucleotides. For example, in the start codon (AUG), the first nucleotide is A, the second nucleotide is U, and the third nucleotide is G.

A nucleotide usually contains a sugar portion, a base portion, and a phosphate portion. The sugar portion is a portion corresponding to a sugar contained in the nucleotide, the base portion is a portion corresponding to a base contained in the nucleotide, and the phosphate portion is a portion corresponding to a phosphate contained in the nucleotide.

Herein, a nucleotide having a sugar portion modified is designated as a "sugar modified nucleotide", a nucleotide having a base portion modified is designated as a "base modified nucleotide", and a nucleotide having a phosphate portion modified is designated as a "phosphate modified nucleotide". Herein, the term "modification" means change of the structure of the sugar portion, the base portion, or the phosphate portion. The structural change by modification is not especially limited. An example of the modification includes substitution in an optional site with an optional substituent.

Herein, substitution with H of OH bonded to carbon in the 2' position of the sugar portion (namely, substitution of a ribose portion with a 2'-deoxyribose portion), and substitution with OH of H bonded to carbon in the 2' position of the sugar portion (namely, substitution of a 2'-deoxyribose portion with a ribose portion) are not encompassed in the modification of the sugar portion. Therefore, based on a ribonucleotide, a 2'-deoxyribonucleotide corresponding to the ribonucleotide is not a "sugar modified nucleotide". Based on a 2'-deoxyribonucleotide, a ribonucleotide corresponding to the 2'-deoxyribonucleotide is not a "sugar modified nucleotide".

An unmodified sugar portion is preferably a sugar portion corresponding to ribose or 2'-deoxyribose, and more preferably a sugar portion corresponding to ribose. In other words, in the polynucleotide of the present embodiment, a nucleotide excluding the sugar modified nucleotide preferably contains a sugar portion corresponding to ribose or 2'-deoxyribose, and more preferably contains a sugar portion corresponding to ribose.

[Sugar Modified Nucleotide]

Figure 2:
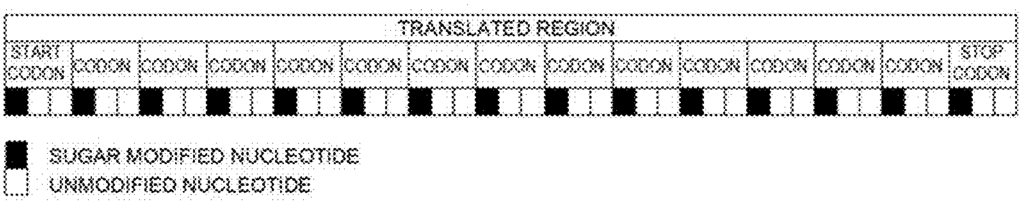
FIG. 2 is a schematic diagram of a translated region in which first nucleotides in all codons are sugar modified nucleotides.

In the polynucleotide of the present embodiment, at least two of the first nucleotides contained in the plurality of codons contained in the translated region are sugar modified nucleotides. The position of each codon containing the sugar modified nucleotide is not especially limited. A ratio that the first nucleotides are sugar modified nucleotides is preferably 5% or more, 10% or more, 15% or more, 20% or more, 25% or more, 30% or more, 35% or more, 40% or more, 45% or more, 50% or more, 55% or more, 60% or more, 65% or more, 70% or more, 75% or more, 80% or more, 85% or more, 90% or more, 95% or more, or 100%. The ratio being 100% means that all the first nucleotides are sugar modified nucleotides. As the ratio is higher, stability against an enzyme tends to be excellent. FIG. 2 is a schematic diagram of a translated region in which all the first nucleotides are sugar modified nucleotides. Although not especially limited, when the first nucleotide is a sugar modified nucleotide, a substituent in the 2' position of the sugar portion of the first nucleotide is preferably fluorine.

In the polynucleotide of the present embodiment, at least one of the second nucleotides contained in the plurality of codons contained in the translated region may be a sugar modified nucleotide, or the sugar portion of the second nucleotide may not be modified. A ratio that the second nucleotides are sugar modified nucleotides may be 50% or less, 45% or less, 40% or less, 35% or less, 30% or less, 25% or less, 20% or less, 15% or less, 10% or less, 5% or less, or 0%. The ratio being 0% means that none of the second nucleotides are sugar modified nucleotides. Although not especially limited, when the second nucleotide is a sugar modified nucleotide, a substituent in the 2' position of the sugar portion of the second nucleotide is preferably fluorine.

In the polynucleotide of the present embodiment, at least one of the third nucleotides contained in the plurality of codons contained in the translated region may be a sugar modified nucleotide. A ratio that the third nucleotides are sugar modified nucleotides may be 100%, 90% or less, 80% or less, 70% or less, 60% or less, 50% or less, 45% or less, 40% or less, 35% or less, 30% or less, 25% or less, 20% or less, 15% or less, 10% or less, 5% or less, or 0%.

Figure 3:
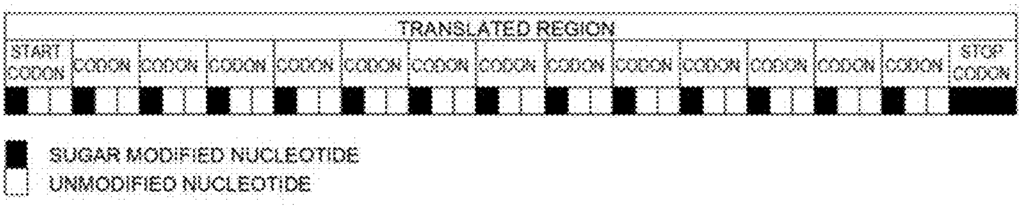
FIG. 3 is a schematic diagram of a translated region in which first nucleotides in all codons, and three nucleotides contained in a stop codon are all sugar modified nucleotides.

In the polynucleotide of the present embodiment, from the viewpoint of improving translation activity, the first, second and third nucleotides of the stop codon may be sugar modified nucleotides. FIG. 3 is a schematic diagram of a translated region in which all the first nucleotides and the nucleotides of the stop codon are all sugar modified nucleotides.

In the polynucleotide of the present embodiment, from the viewpoint of improving the stability against a nuclease, the first, second and third nucleotides of the start codon may be sugar modified nucleotides. Although not especially limited, substituents in the 2' position of the sugar portions of the first, second and third nucleotides of the start codon are preferably all fluorine.

The sugar modified nucleotide is not especially limited as long as the sugar portion of the nucleotide is modified, and preferably contains a sugar portion modified at least in the 2' position. When the 2' position is modified, the stability against an enzyme can be improved. The sugar portion modified at least in the 2' position may be a sugar portion having the 2' position and the 4' position cross-linked.

An example of the modified sugar portion includes the following:

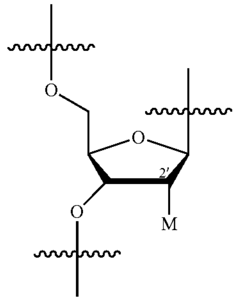

wherein M is $R^1$, $OR^1$, $R^2OR^1$, SH, $SR^1$, $NH_2$, $NHR^1$, $NR^1_2$, $N_3$, CN, F, Cl, Br or I, $R^1$ each independently is alkyl or aryl, preferably alkyl having 1 to 6 carbon atoms, and more preferably alkyl having 1 to 3 carbon atoms, and $R^2$ is alkylene, and preferably alkylene having 1 to 6 carbon atoms.

Herein, an example of alkyl having 1 to 6 carbon atoms includes a linear or branched alkyl having 1 to 6 carbon atoms. Examples of the linear alkyl having 1 to 6 carbon atoms include methyl, ethyl, propyl, butyl, pentyl, and hexyl. Examples of the branched alkyl having 1 to 6 carbon atoms include isopropyl, isobutyl, sec-butyl, tert-butyl, and methyl-substituted pentyl.

Examples of alkyl having 1 to 3 carbon atoms include methyl, ethyl, propyl, and isopropyl.

Herein, examples of aryl include optionally substituted phenyl, and optionally substituted naphthyl.

Herein, alkylene having 1 to 6 carbon atoms is a group obtained by removing one hydrogen atom bonded to a carbon atom of alkyl having 1 to 6 carbon atoms.

Herein, the modified sugar portion refers to a modified sugar structure contained in the sugar modified nucleotide. Other examples of M in the modified sugar portion include 2-(methoxy)ethoxy, 3-aminopropoxy, 2-[(N,N-dimethylamino)oxy]ethoxy, 3-(N,N-dimethylamino)propoxy, 2-[2-(N,N-dimethylamino)ethoxy]ethoxy, 2-(methylamino)-2-oxoethoxy, 2-(N-methylcarbamoyl)ethoxy), and 2-cyanoethoxy.

Other examples of the modified sugar portion include sugar portions of the following nucleic acids:

Locked Nucleic Acid (LNA) [Tetrahedron Letters, 38, 8735 (1997) and Tetrahedron, 54, 3607 (1998)];

Ethylene bridged nucleic acid (ENA) [Nucleic Acids Research, 32, e175 (2004)];

Constrained Ethyl (cEt) [The Journal of Organic Chemistry 75, 1569 (2010)];

Amido-Bridged Nucleic Acid (AmNA) [Chem Bio Chem 13, 2513 (2012)];

2'-O,4'-c-Spirocyclopropylene bridged nucleic acid (scpBNA) [Chem. Commun., 51, 9737 (2015)];

tricycloDNA (tcDNA) [Nat. Biotechnol., 35, 238 (2017)];

Unlocked Nucleic Acid (UNA) [Mol. Ther. Nucleic Acids 2, e103 (2013)];

3'-fluoro hexitol nucleic acid (FHNA) [Nat. Biotechnol., 35, 238 (2017)];

peptide nucleic acid (PNA) [Acc. Chem. Res., 32, 624 (1999)];

oxy-peptide nucleic acid (OPNA) [J. Am. Chem. Soc., 123, 4653 (2001)]; and peptide ribonucleic acid (PRNA) [J. Am. Chem. Soc., 122, 6900 (2000)].

The modified sugar portion is not especially limited, but is preferably selected from the following:

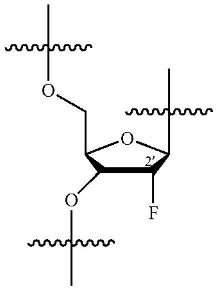

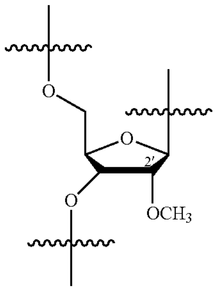

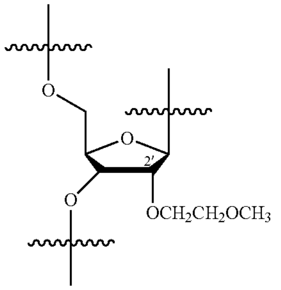

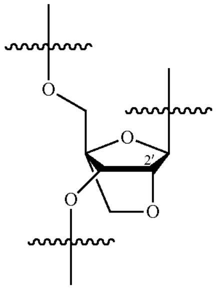

The sugar modified nucleotide preferably contains a base portion corresponding to a base selected from the group consisting of adenine (A), guanine (G), cytosine (C), and uracil (U), and the number of types of the base is preferably at least two. Here, the term "the number of types of the base being at least two" means, for example, that one sugar modified nucleotide contains a base portion corresponding to adenine and another sugar modified nucleotide contains a base portion corresponding to guanine.

The sugar modified nucleotide may be a base modified nucleotide and/or a phosphate modified nucleotide (in other words, the sugar modified nucleotide may further contain a modified base portion and/or a modified phosphate portion). At least one sugar modified nucleotide may contain a modified base portion.

[Base Modified Nucleotide]

The translated region may contain a base modified nucleotide. The position of the base modified nucleotide in the translated region is not especially limited. The base modified nucleotide may be a sugar modified nucleotide and/or a phosphate modified nucleotide (in other words, the base modified nucleotide may further contain a modified sugar portion and/or a modified phosphate portion).

The base modified nucleotide is not especially limited as long as a base portion of a nucleotide is modified. Examples of an unmodified base portion include base portions corresponding to adenine, guanine, cytosine, and uracil. Examples of a modified base portion include a base portion in which oxygen of an unmodified base portion is substituted with sulfur, a base portion in which hydrogen of an unmodified base portion is substituted with alkyl having 1 to 6 carbon atoms, halogen or the like, a base portion in which methyl of an unmodified base portion is substituted with hydrogen, hydroxymethyl, alkyl having 2 to 6 carbon atoms or the like, and a base portion in which amino of an unmodified base portion is substituted with alkyl having 1 to 6 carbon atoms, alkanoyl having 1 to 6 carbon atoms, oxo, hydroxy or the like.

Specific examples of the base modified nucleotide include 5-methylcytosine (5-me-C), 5-hydroxymethylcytosine, xanthine, hypoxanthine, 2 aminoadenine, 6-methyladenine, 6-methylguanine, 2 propyladenine, 2-propylguanine, 2-thiouracil, 2-thiothymine, 2-thiocytosine, 5-propynyluracil, 5-propynylcytosine, 6-azouracil, 6-azocytosine, 6 azothimine, 5-pseudouracil, 4-thiouracil, 8-haloadenine, 8-haloguanine, 8-aminoadenine, 8-aminoguanine, 8-mercaptoadenine, 8-mercaptoguanine, 8-alkylthioadenine, 8-alkylthioguanine, 8-hydroxyadenine, 8-hydroxyguanine, 5-bromouracil, 5-bruomocytosine, 5-trifluoromethyluracil, 5-trifluoromethyluracil, 7-methylguanine, 7-methyladenine, 8-azaguanine, 8-azaadenine, 7-deazaguanine, 3-deazaguanine, 7-deazaadenine, 3-deazaadenine, pyrazolo[3,4-d]pyrimidine, imidazo[1,5-a]1,3,5 triazinone, 9-deazapurine, imidazo[4,5-d]pyrazine, thiazolo[4,5-d]pyrimidine, pyrazine-2-one, 1,2,4-triazine, pyridazine, and 1,3,5-triazine.

[Phosphate Modified Nucleotide]

The translated region may contain a phosphate modified nucleotide. The position of the phosphate modified nucleotide in the translated region is not especially limited. The phosphate modified nucleotide may be a sugar modified nucleotide and/or a base modified nucleotide (in other words, the phosphate modified nucleotide may further contain a modified sugar portion and/or a modified base portion).

The phosphate modified nucleotide is not especially limited as long as a phosphate portion (phosphodiester bond) of a nucleotide is modified. Examples of a modified phosphate portion include a phosphorothioate bond, a phosphorodithioate bond, an alkylphosphonate bond, and a phosphoramidate bond.

The translated region may contain a phosphate modified nucleotide having an optical isomer (Rp, Sp) in a modified phosphate portion. A method for selectively synthesizing an optical isomer of a phosphorothioate bond is disclosed in, for example, J. Am. Chem. Soc., 124, 4962 (2002), Nucleic Acids Research, 42, 13546 (2014), and Science 361, 1234 (2018).

(5' Untranslated Region)

The polynucleotide of the present embodiment may further contain a 5' untranslated region (5' UTR). The 5' untranslated region is a region that is present upstream (on the 5' end side) of the translated region, and is not translated for polypeptide synthesis. The number of nucleotides contained in the 5' untranslated region is preferably an integer of 1 to 1000, more preferably an integer of 1 to 500, further preferably an integer of 1 to 250, and particularly preferably an integer of 1 to 100.

The 5' untranslated region may contain a sugar modified nucleotide. The position of the sugar modified nucleotide is not especially limited, and from the viewpoint of improving translation activity, the first, second and third nucleotides from the 5' end may be sugar modified nucleotides.

Alternatively, all nucleotides contained in the 5' untranslated region may be sugar modified nucleotides.

Specific examples of a modified sugar portion of the sugar modified nucleotide include those mentioned in the section [Sugar Modified Nucleotide] in (Translated Region) described above.

The 5' untranslated region may contain a base modified nucleotide. The position of the base modified nucleotide in the 5' untranslated region is not especially limited. The base modified nucleotide may be a sugar modified nucleotide and/or a phosphate modified nucleotide (in other words, the base modified nucleotide may further contain a modified sugar portion and/or a modified phosphate portion).

Specific examples of a modified base portion of the base modified nucleotide include those mentioned in the section [Base Modified Nucleotide] in (Translated Region)

described above. Although not especially limited, from the viewpoint of improving translation activity, the 5' untranslated region preferably contains the following modified base portion:

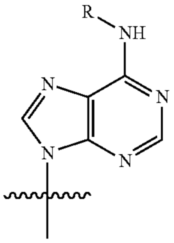

wherein R is an alkyl group having 1 to 6 carbon atoms.

The alkyl group R in the modified base portion is preferably methyl or ethyl.

Specific examples of alkyl having 1 to 6 carbon atoms include those mentioned in the section [Sugar Modified Nucleotide] in (Translated Region) described above.

The 5' untranslated region may contain a phosphate modified nucleotide. The position of the phosphate modified nucleotide in the 5' untranslated region is not especially limited. The phosphate modified nucleotide may be a sugar modified nucleotide and/or a base modified nucleotide (in other words, the phosphate modified nucleotide may further contain a modified sugar portion and/or a modified base portion).

Specific examples of a modified phosphate portion of the phosphate modified nucleotide include those mentioned in the section [Phosphate Modified Nucleotide] in (Translated Region) described above.

(5' Cap Structure)

The polynucleotide of the present embodiment may further contain a 5' cap structure. The 5' cap structure is present upstream of the 5' untranslated region. When the 5' cap structure is contained, translation activity tends to be improved.

(3' Untranslated Region)

The polynucleotide of the present embodiment may further contain a 3' untranslated region (3' UTR). The 3' untranslated region is a region that is present downstream of the translated region, and is not translated for polypeptide synthesis.

The number of nucleotides contained in the 3' untranslated region is preferably an integer of 1 to 6000, more preferably an integer of 1 to 3000, further preferably an integer of 1 to 1000, and particularly preferably an integer of 1 to 500.

The 3' untranslated region may contain a poly A chain. The 3' untranslated region may contain both a polynucleotide excluding a poly A chain, and a poly A chain, or may contain only one of these. When the poly A chain is contained, translation activity tends to be improved.

The poly A chain has a length of preferably 1 to 500 bases, more preferably 1 to 200 bases, and further preferably 1 to 40 bases.

The 3' untranslated region may contain a sugar modified nucleotide. The position of the sugar modified nucleotide is not especially limited. The sugar modified nucleotide may be contained in both a polynucleotide excluding a poly A chain, and a poly A chain, or may be contained in only one of these. From the viewpoint of improving translation activity, the first, second, and third nucleotides from the 3' end of the 3' untranslated region may be sugar modified nucleotides. Although not especially limited, substituents in the 2' position of sugar portions of the first, second and third nucleotides from the 3' end are preferably all 2'-O-methoxyethyl (MOE) groups.

Specific examples of a modified sugar portion of the sugar modified nucleotide include those mentioned in the section [Sugar Modified Nucleotide] in (Translated Region) described above.

The 3' untranslated region may contain a base modified nucleotide. The position of the base modified nucleotide in the 3' untranslated region is not especially limited. The base modified nucleotide may be a sugar modified nucleotide and/or a phosphate modified nucleotide (in other words, the base modified nucleotide may further contain a modified sugar portion and/or a modified phosphate portion).

Specific examples of a modified base portion of the base modified nucleotide include those mentioned in the section [Base Modified Nucleotide] in (Translated Region) described above.

The 3' untranslated region may contain a phosphate modified nucleotide. The position of the phosphate modified nucleotide in the 3' untranslated region is not especially limited. The phosphate modified nucleotide may be a sugar modified nucleotide and/or a base modified nucleotide (in other words, the phosphate modified nucleotide may further contain a modified sugar portion and/or a modified base portion).

Specific examples of a modified phosphate portion of the phosphate modified nucleotide include those mentioned in the section [Phosphate Modified Nucleotide] in (Translated Region) described above.

Since the phosphate modified nucleotide can impart stability against endonuclease, that is, one of nucleases, two or more phosphate modified nucleotides are preferably continuously contained from the 5' end and/or the 3' end of the polynucleotide of the present invention.

(Linking Portion)

The polynucleotide of the present embodiment may contain the following linking portion:

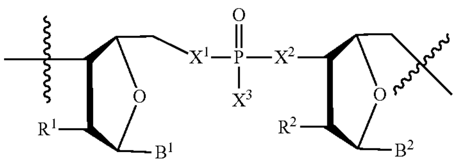

wherein $R^1$ and $R^2$ each independently represent H, OH, F or $OCH_3$, $B^1$ and $B^2$ each independently represent a base portion, $X^1$ represents O, S or NH, and $X^2$ represents O, S, NH or the following structure:

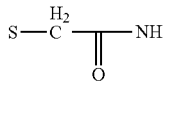

wherein $X^3$ represents OH, SH or a salt thereof (wherein OH and SH of $X^3$ may be indicated respectively as $O^-$ and $S^-$), and $X^1$ and $X^2$ are not simultaneously O.

Nucleotides disposed on the left side and the right side of the linking portion are two nucleotides contained in the polynucleotide of the present embodiment. Even when the linking portion is contained, translation activity can be retained. A nucleotide A on the right side (5' end side) and a nucleotide B on the left side (3' end side) of the linking portion, and a nucleotide C adjacent to the nucleotide B on the 3' end side and a nucleotide D adjacent to the nucleotide C on the 3' end side may not be modified.

Examples of salts of OH and SH of $X^3$ in the linking portion include pharmaceutically acceptable salts. Examples of the pharmaceutically acceptable salts include an alkali metal salt, an alkaline earth metal salt, an ammonium salt, an organic amine salt, and an amino acid salt. Examples of the alkali metal salt include a sodium salt, a lithium salt, and a potassium salt. Examples of the alkaline earth metal salt include a calcium salt and a magnesium salt.

Specific examples of the linking portion include the following:

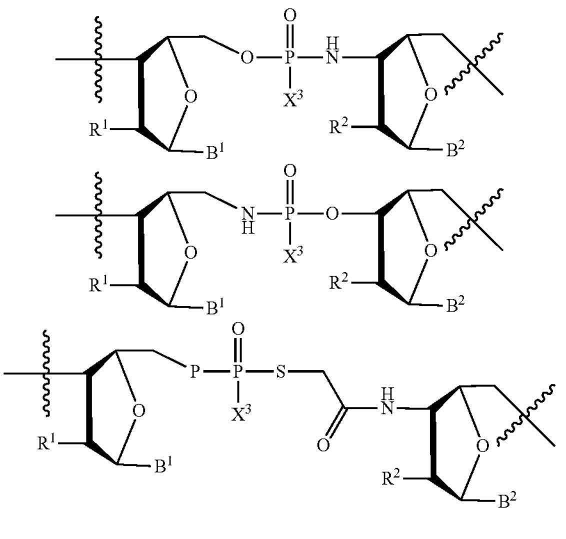

wherein $R^1$, $R^2$, $B^1$, $B^2$, and $X^3$ are the same as those defined above.

The position of the linking portion is not especially limited. The linking portion may be present in any one of the translated region, the 5' untranslated region, and the 3' untranslated region, and when the linking portion is present, the linking portion is preferably present at least in the translated region.

The number of the linking portions is not especially limited, and can be appropriately selected in accordance with the length of the polynucleotide. The number of the linking portions can be, for example, 1 to 200, 1 to 100, 1 to 50, 1 to 20, 1 to 10, 1 to 8, 1 to 6, 1 to 4, 1 to 3, or 1 or 2.

In the polynucleotide of the present embodiment, the first nucleotide and the second nucleotide in at least one codon of the plurality of codons contained in the translated region may be linked to each other via phosphorothioate. The number of phosphorothioate bonds is not especially limited, and can be appropriately selected in accordance with the length of the polynucleotide. The number of phosphorothioate bonds can be, for example, 1 to 200, 1 to 100, 1 to 50, 1 to 20, 1 to 10, 1 to 8, 1 to 6, 1 to 4, 1 to 3, or 1 or 2.

From the viewpoint of improving translation activity, the first to second nucleotides, the first to third nucleotides, the first to fourth nucleotides, or the first to fifth nucleotides from the 5' end of the 5' untranslated region may be linked to one another via phosphorothioate. For example, that the first to third nucleotides are linked to one another via phosphorothioate means that the first nucleotide and the second nucleotide are linked to each other via phosphorothioate, and the second nucleotide and the third nucleotide are linked to each other via phosphorothioate.

From the viewpoint of improving translation activity, the first to second nucleotides, the first to third nucleotides, the first to fourth nucleotides, or the first to fifth nucleotides from the 3' end of the 3' untranslated region may be linked to one another via phosphorothioate.

Another embodiment of the present invention relates to a polynucleotide containing a translated region and a 5' untranslated region, in which the first, second and third nucleotides from the 5' end of the 5' untranslated region are sugar modified nucleotides.

Another embodiment of the present invention relates to a polynucleotide containing a translated region and a 3' untranslated region, in which the first, second and third nucleotides from the 3' end of the 3' untranslated region are sugar modified nucleotides.

Another embodiment of the present invention relates to a polynucleotide containing a translated region, a 5' untranslated region, and a 3' untranslated region, in which the first, second and third nucleotides from the 5' end of the 5' untranslated region are sugar modified nucleotides, and the first, second and third nucleotides from the 3' end of the 3' untranslated region are sugar modified nucleotides.

Another embodiment of the present invention relates to a polynucleotide containing a translated region and a 5' untranslated region, in which the first to third nucleotides, the first to fourth nucleotides, or the first to fifth nucleotides from the 5' end of the 5' untranslated region are linked to one another via phosphorothioate.

Another embodiment of the present invention relates to a polynucleotide containing a translated region and a 3' untranslated region, in which the first to third nucleotides, the first to fourth nucleotides, or the first to fifth nucleotides from the 3' end of the 3' untranslated region are linked to one another via phosphorothioate.

Another embodiment of the present invention relates to a polynucleotide containing a translated region, a 5' untranslated region, and a 3' untranslated region, in which the first to third nucleotides, the first to fourth nucleotides, or the first to fifth nucleotides from the 5' end of the 5' untranslated region are linked to one another via phosphorothioate, and the first to third nucleotides, the first to fourth nucleotides, or the first to fifth nucleotides from the 3' end of the 3' untranslated region are linked to one another via phosphorothioate.

Another embodiment of the present invention relates to a polynucleotide containing a translated region and a 5' untranslated region, in which the first, second and third nucleotides from the 5' end of the 5' untranslated region are sugar modified nucleotides, and the first to third nucleotides, the first to fourth nucleotides, or the first to fifth nucleotides from the 5' end of the 5' untranslated region are linked to one another via phosphorothioate.

Another embodiment of the present invention relates to a polynucleotide containing a translated region and a 3' untranslated region, in which the first, second and third nucleotides from the 3' end of the 3' untranslated region are sugar modified nucleotides, and the first to third nucleotides, the first to fourth nucleotides, or the first to fifth nucleotides from the 3' end of the 3' untranslated region are linked to one another via phosphorothioate.

Another embodiment of the present invention relates to a polynucleotide containing a translated region, a 5' untrans-lated region, and a 3' untranslated region, in which the first, second and third nucleotides from the 5' end of the 5' untranslated region are sugar modified nucleotides, the first to third nucleotides, the first to fourth nucleotides, or the first to fifth nucleotides from the 5' end of the 5' untranslated region are linked to one another via phosphorothioate, the first, second and third nucleotides from the 3' end of the 3' untranslated region are sugar modified nucleotides, and the first to third nucleotides, the first to fourth nucleotides, or the first to fifth nucleotides from the 3' end of the 3' untranslated region are linked to one another via phosphorothioate.

(Other Sequences)

The polynucleotide of the present embodiment may further contain a Kozak sequence and/or a ribosome binding sequence (RBS).

<Method for Producing Polynucleotide>

The polynucleotide of the present embodiment can be produced by, for example, chemical synthesis. Specifically, the polynucleotide of the present embodiment can be produced by a known chemical synthesis method by introducing a prescribed sugar modified nucleotide into a prescribed position with elongating a polynucleotide chain. Examples of the known chemical synthesis method include a phosphoramidite method, a phosphorothioate method, a phosphotriester method, and a CEM method (see Nucleic Acids Research, 35, 3287 (2007)). In addition, an ABI3900 high-throughput nucleic acid synthesizer (manufactured by Applied Biosystems, Inc.) can be utilized.

More specifically, the known chemical synthesis method can be a method described in any of the following literatures:

Tetrahedron, Vol. 48, No. 12, p. 2223-2311 (1992);

Current Protocols in Nucleic Acids Chemistry, John Wiley & Sons (2000);

Protocols for Oligonucleotides and Analogs, Human Press (1993);

Chemistry and Biology of Artificial Nucleic Acids, Wiley-VCH (2012);

Genome Chemistry Jinko Kakusan wo Katsuyo suru Kagakuteki Approach (Scientific approach for utilizing artificial nucleic acids), Kodansha Ltd. (2003); and New Trend of Nucleic Acid Chemistry, Kagaku-Dojin Publishing Company, Inc. (2011).

The polynucleotide of the present embodiment can be produced by chemically synthesizing a commercially unavailable phosphoramidite to be used as a raw material.

A method for synthesizing phosphoramidite (f) to be used as a raw material of a base modified nucleotide is as follows:

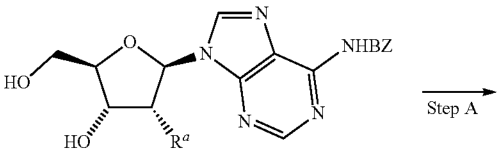

(a)

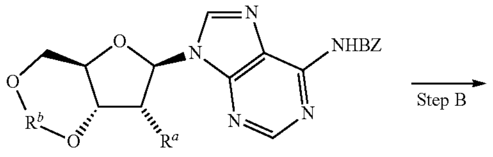

(b)

-continued

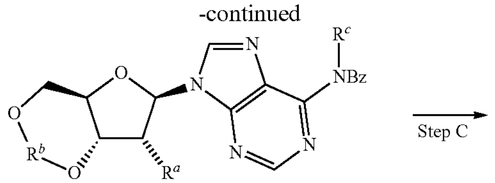

(c)

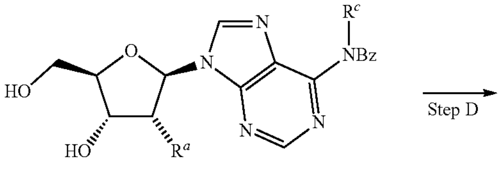

(d)

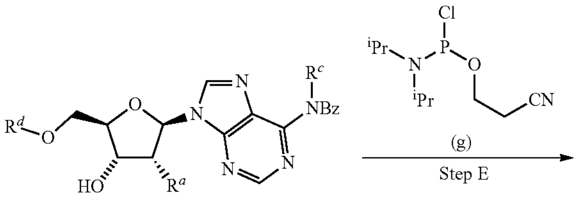

(e)

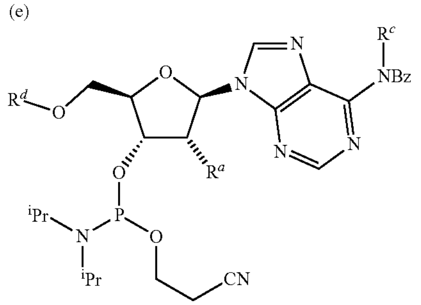

(f)

In the synthetic scheme, Ra represents a hydrogen atom, F, OMe or OCH2CH2OMe, Rb is a protecting group removable with a fluoride ion such as di-tert-butylsilyl, Rc represents alkyl having 1 to 6 carbon atoms, Rd is a protecting group used in nucleic acid solid phase synthesis, and represents, for example, a p,p'-dimethoxytrityl group.

(Step A)

A compound (b) can be produced by reacting a compound (a) and, for example, a corresponding silylating agent in a solvent in the presence of a base at a temperature between 0° C. and 80° C. for 10 minutes to 3 days.

Examples of the solvent include DMF, DMA, and NMP, and one of these or a mixture of these can be used.

Examples of the base include imidazole, triethylamine, and diisopropylethylamine.

An example of the silylating agent includes di-tert-butylsilyl bis(trifluoromethanesulfonate).

(Step B)

A compound (c) can be produced by reacting the compound (b) and a corresponding alkylating agent in a solvent in the presence of a base at a temperature between 0° C. and 150° C. for 10 minutes to 3 days. The reaction can be accelerated by adding an adequate additive.

Examples of the solvent include DMF, pyridine, dichloromethane, THF, ethyl acetate, 1,4-dioxane, and NMP, and one of these or a mixture of these is used.

Examples of the base include a sodium hydroxide aqueous solution, potassium carbonate, pyridine, triethylamine, and N-ethyl-N,N-diisopropylamine.

Examples of the alkylating agent include methyl iodide, ethyl iodide, and methyl bromide.

An example of the additive includes tetrabutylammonium bromide.

(Step C)

A compound (d) can be produced by reacting the compound (c) and a fluorine reagent in a solvent at a temperature between −80° C. and 200° C. for 10 seconds to 72 hours. At this point, a base can be also added.

Examples of the fluorine reagent include hydrogen fluoride, triethylamine hydrofluoride, and tetrabutylammonium fluoride (TBAF).

Examples of the base include triethylamine, and N,N-diisopropylethylamine.

Examples of the solvent include dichloromethane, chloroform, acetonitrile, toluene, ethyl acetate, THF, 1,4-dioxane, DMF, N,N-dimethylacetamide (DMA), NMP, and dimethylsulfoxide (DMSO).

(Step D)

A compound (e) can be produced by reacting the compound (d) and a corresponding alkylating agent in a solvent in the presence of a base at a temperature between 0° C. and 150° C. for 10 minutes to 3 days. The reaction can be accelerated by an adequate activator.

Examples of the solvent include DMF, pyridine, dichloromethane, THF, ethyl acetate, 1,4-dioxane, and NMP, and one of these or a mixture of these is used.

Examples of the base include pyridine, triethylamine, N-ethyl-N,N-diisopropylamine, and 2,6-lutidine.

Examples of the alkylating agent include tritylchloride, and p,p'-dimethoxytritylchloride.

An example of the activator includes 4-dimethylaminopyridine.

(Step E)

A compound (f) can be produced by reacting the compound (e) and a compound (g) in a solvent in the presence of a base at a temperature between 0° C. and 100° C. for 10 seconds to 24 hours.

Examples of the solvent include dichloromethane, acetonitrile, toluene, ethyl acetate, THF, 1,4-dioxane, DMF and NMP, and one of these or a mixture of these is used.

Examples of the base include triethylamine, N,N-diisopropylethylamine, and pyridine, and one of these or a mixture of these is used.

The 5' cap structure can be introduced by a known method (such as an enzymatic method or a chemical synthesis method). Examples of the known method include methods described in Top. Curr. Chem. (Z) (2017) 375:16 and Beilstein J. Org. Chem. 2017, 13, 2819-2832.

When the base length of the polynucleotide of the present embodiment is long, a plurality of polynucleotide units may be linked to one another. A linking method is not especially limited, and examples include an enzymatic method and a chemical synthesis method.

Linking by an enzymatic method can be, for example, linking with a ligase. Examples of the ligase include T4 DNA ligase, T4 RNA ligase 1, T4 RNA ligase 2, T4 RNA ligase 2, truncated T4 RNA ligase 2, truncated KQ, *E. coli* DNA ligase, and Taq. DNA ligase, and one of these or a mixture of these can be used. In the enzymatic method, it is generally preferable that a nucleotide A at the 3' end of a polynucleotide unit contained on the 5' end side of a polynucleotide (hereinafter referred to as the "polynucleotide unit on the 5' end side"), a nucleotide B at the 5' end of a polynucleotide unit contained on the 3' end side of the polynucleotide (hereinafter referred to as the "polynucleotide unit on the 3' end side") (the nucleotides A and B being adjacent to each other in the linked polynucleotide), a nucleotide C adjacent to the nucleotide B, and a nucleotide D adjacent to the nucleotide C are not modified. On the other hand, the nucleotides A to D may be modified if T4 RNA ligase 2 or the like described in Molecular Cell, Vol. 16, 211-221, Oct. 22, 2004 is used.

In the linking by the enzymatic method, polydisperse polyethylene glycol (PEG) may be used for accelerating the linking reaction by molecular crowding effect. Examples of the polydisperse PEG include PEG 4000, PEG 6000, PEG 8000, and PEG 10000, and one of these or a mixture of these can be used.

Linking by a chemical synthesis method (also referred to as "chemical ligation") can be, for example, the following method in which the 3' end (on the right side in the following) of a polynucleotide unit on the 5' end side and the 5' end (on the left side in the following) of a polynucleotide unit on the 3' end side are condensed in the presence of a condensing agent:

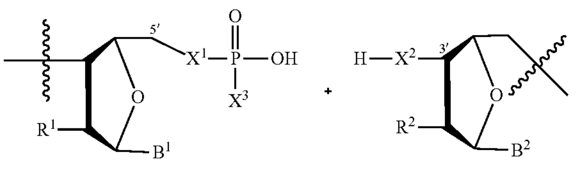

wherein $R^1$, $R^2$, $B^1$, $B^2$, $X^1$, $X^2$ and $X^3$ are the same as those defined above.

Examples of the condensing agent include 1,3-dicyclohexanecarbodiimide (DCC), 1-ethyl-3-(3-dimethylaminopropyl)carbodiimide hydrochloride (EDC), carbonyldiimidazole, benzotriazole-1-yloxytris(dimethylamino) phosphonium hexafluorophosphate, (benzotriazole-1-yloxy) tripyrrolidinophosphonium hexafluorophosphate, O-(7-azabenzotriazole-1-yl)-N,N,N',N'-tetramethyluronium hexafluorophosphate (HATU), 0-(benzotriazole-1-yl)-N,N,N',N'-tetramethyluronium hexafluorophosphate (HBTU), and 2-chloro-1-methylpyridinium iodide.

The condensation reaction is performed preferably in the presence of a template DNA containing nucleotide chains complementary to a nucleotide chain on the 3' end side of the polynucleotide unit on the 5' end side and a nucleotide chain on the 5' end side of the polynucleotide unit on the 3' end side. The template DNA is preferably a nucleotide chain complementary to a nucleotide chain of preferably 2-50 base length, and more preferably 5-40 base length from the 3' end of the polynucleotide unit on the 5' end side, and to a nucleotide chain of preferably 2-50 base length, and more preferably 5-40 base length from the 5' end of the polynucleotide unit on the 3' end. Here, the term "complementary" means that base sequence identity is, for example, 50% or more, 60% or more, 70% or more, 80% or more, 90% or more, or 100%.

In the condensation reaction, an additive may be added. Examples of the additive include 1-hydroxybenzotriazole (HOBt), and 4-dimethylaminopyridine (DMAP).

The condensation reaction may be performed in the presence of a buffer. Examples of the buffer include acetate buffer, Tris buffer, citrate buffer, phosphate buffer, and water.

The temperature in the condensation reaction is not especially limited, and may be, for example, room temperature to 200° C. The time of the condensation reaction is not especially limited, and may be, for example, 5 minutes to 100 hours.

Specific examples of the condensation reaction between the 3' end (on the right side in the following) of the polynucleotide unit on the 5' end side and the 5' end (on the left side in the following) of the polynucleotide unit on the 3' end side include the following:

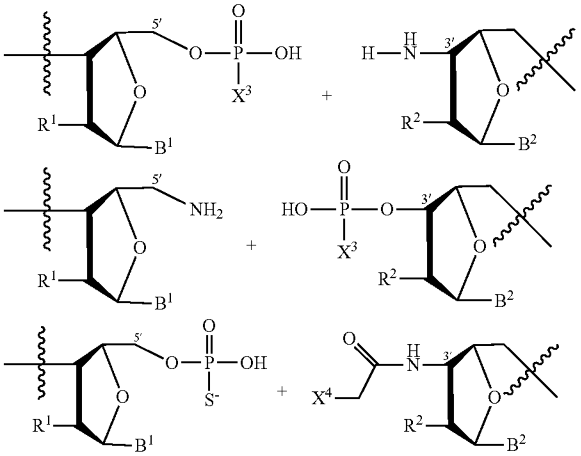

wherein $R^1$, $R^2$, $B^1$, $B^2$, and $X^3$ are the same as those defined above, and $X^4$ is a leaving group.

Specific examples of the leaving group include a chloro group, a bromo group, an iodo group, a methanesulfonyl group, a p-toluenesulfonyl group, and a trifluoromethanesulfonyl group. The leaving group is not especially limited, and is preferably a chloro group or a bromo group.

The linking of the polynucleotide units may be repeated a plurality of times in accordance with the length of the polynucleotide to be obtained. The number of times of the linking is not especially limited, and may be, for example, 1 to 200 times, 1 to 100 times, 1 to 50 times, 1 to 20 times, 1 to 10 times, 1 to 8 times, 1 to 6 times, 1 to 4 times, 1 to 3 times, or once or twice.

A method for producing a compound (M) and a compound (N), that is, the polynucleotide units on the 5' end side used in the linking is as follows:

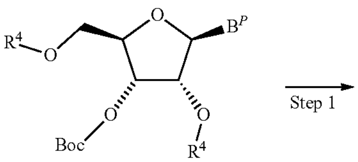

(A)

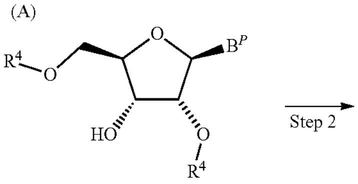

(B)

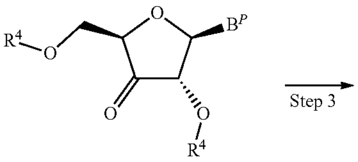

(C)

-continued

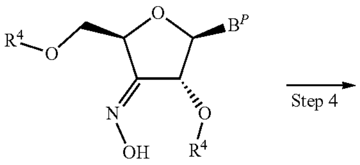

(D)

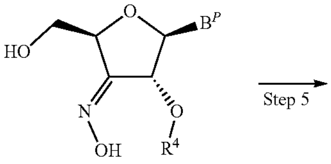

(E)

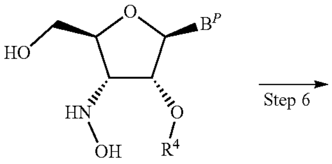

(F)

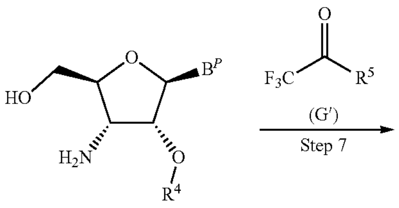

(G)

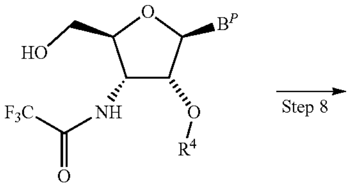

(H)

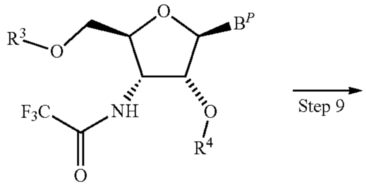

(I)

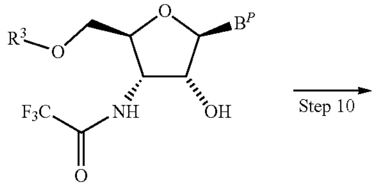

(J)

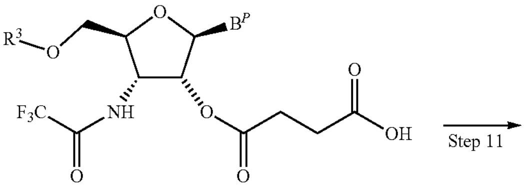

(K)

-continued

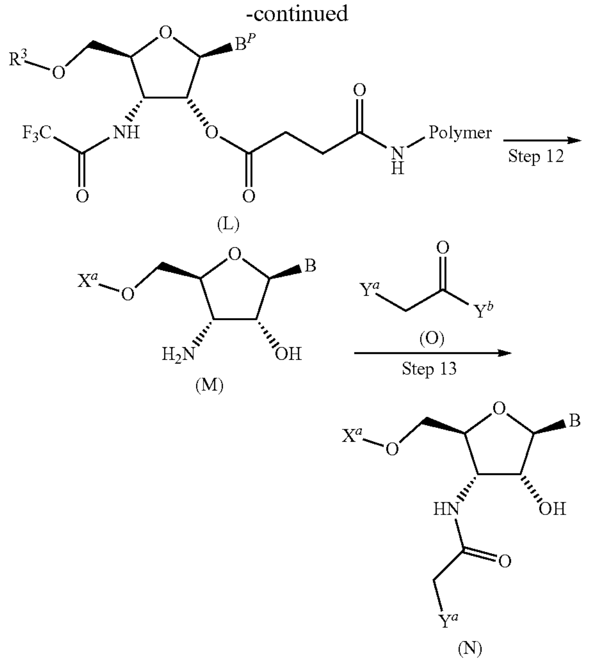

(L) (M) (O) (N)

wherein BP represents a base optionally protected by a protecting group, B represents a base, and Polymer represents a solid support. $R^4$ is a protecting group selectively deprotectable, and represents, for example, a tert-butyldimethylsilyl group or a triethylsilyl group, $R^3$ is a protecting group used in nucleic acid solid phase synthesis, and represents, for example, a p,p'-dimethoxytrityl group, $X^a$ represents a nucleic acid sequence, and $Y^a$ and $Y^b$ are each independently a leaving group, and represent, for example, halogen, and preferably a chlorine atom or a bromine atom. Herein, a nucleic acid sequence refers to a partial structure in a nucleic acid that forms the nucleic acid together with a compound bonded thereto. It is noted that if a plurality of Bs are contained in a molecule, these Bs may be the same or different.

(Step 1)

A compound (B) can be produced by reacting a compound (A) in a solvent at a temperature between 60° C. and a boiling point of the solvent to be used for 10 seconds to 3 days.

Examples of the solvent include toluene, xylene, 1,2-dichloroethane, 1,4-dioxane, N,N-dimethylformamide (DMF), N-methylpyrrolidone (NMP), 1,2-dichlorobenzene, and water, and one of these or a mixture of these can be used.

The compound (A) can be produced by a method described in, for example, J. Am. Chem. Soc. (1999), 121, 5661-5665.

BP in the compound (A) is not especially limited, and preferably has any one of the following structures:

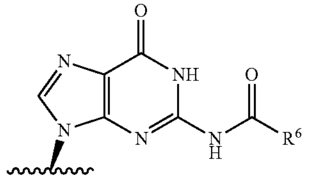

-continued

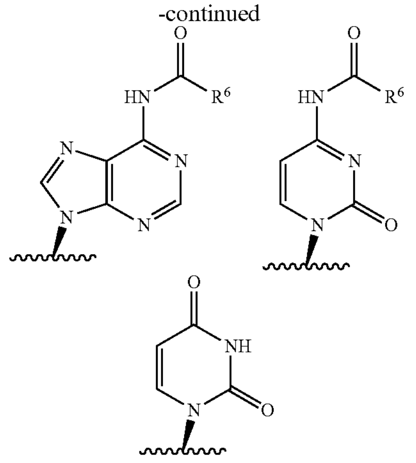

$R^6$ is a group constituting a part of a protecting group of a base, and represents, for example, a methyl group, an isopropyl group, or a phenyl group optionally having a substituent. Examples of the substituent in the phenyl group optionally having a substituent include a methyl group, an isopropyl group, and a tert-butyl group.

(Step 2)

A compound (C) can be produced by reacting the compound (B) in a solvent in the presence of 1 to 100 equivalents of an oxidant at a temperature between 0' and a boiling point of the solvent to be used for 10 seconds to 3 days preferably with 1 to 100 equivalents of an additive.

Examples of the solvent include aprotic solvents such as chloroform and dichloromethane, and one of these or a mixture of these can be used.

Examples of the oxidant include organic oxidants such as Jones reagent, chromic acid, pyridinium dichromate, ruthenium tetroxide, sodium chlorite, and Dess-Martin reagent, and inorganic oxidants such as pyridinium chlorochromate, and one of these or a mixture of these can be used.

Examples of the additive include pyridine, triethylamine, and N,N-diisopropylethylamine, and one of these or a mixture of these can be used.

(Step 3)

A compound (D) can be produced by reacting the compound (C) in a solvent such as pyridine in the presence of hydroxylamine chloride at a temperature between 0° C. and a boiling point of the solvent to be used for 10 seconds to 3 days.

(Step 4)

A compound (E) can be produced by reacting the compound (D) in a solvent in the presence of 1 to 100000 equivalents of a deprotecting agent at a temperature between 0° C. and a boiling point of the solvent to be used for 10 seconds to 3 days.

Examples of the solvent include toluene, xylene, and water, and one of these or a mixture of these can be used.

Examples of the deprotecting agent include trifluoroacetic acid, trichloroacetic acid, acetic acid, and hydrochloric acid, and one of these or a mixture of these can be used.

(Step 5)

A compound (F) can be produced by reacting the compound (E) in a solvent in the presence of a reductant at a temperature between 0° C. and a boiling point of the solvent to be used for 10 seconds to 3 days.

Examples of the solvent include trifluoroacetic acid, trichloroacetic acid, acetic acid, hydrochloric acid, toluene, xylene, toluene, xylene, tetrahydrofuran, methanol, ethanol, 1,4-dioxane, and water, and one of these or a mixture of these can be used.

Examples of the reductant include sodium borohydride, sodium cyanoborohydride, lithium borohydride, and sodium triacetoxyborohydride.

(Step 6)

A compound (G) can be produced by reacting the compound (F) in a solvent in the presence of a catalyst under a hydrogen atmosphere at a temperature between 0° C. and a boiling point of the solvent to be used for 10 seconds to 3 days.

Examples of the solvent include trifluoroacetic acid, acetic acid, dilute hydrochloric acid, methanol, ethanol, isopropanol, and water, and one of these or a mixture of these can be used.

Examples of the catalyst include palladium carbon and ruthenium carbon.

The compound (G) can be produced also by, for example, a method described in International Publication No. WO2017/123669.

(Step 7)

A compound (H) can be produced by reacting the compound (G) in a solvent in the presence of 1 to 100 equivalents of a compound (G') and a base at a temperature between 0° C. and a boiling point of the solvent to be used for 10 seconds to 3 days preferably with 1 to 1000 equivalents of the base.

Examples of the solvent include methanol, ethanol, isopropanol, dichloromethane, acetonitrile, toluene, ethyl acetate, tetrahydrofuran (THF), 1,4-dioxane, N,N-dimethylformamide (DMF), N-methylpyrrolidone (NMP), and water, and one of these or a mixture of these can be used.

Examples of the base include pyridine, triethylamine, N-ethyl-N,N-diisopropylamine, and 2,6-lutidine, and one of these or a mixture of these can be used.

As the compound (G'), a commercially available product can be used.

(Step 8)

A compound (I) can be produced by reacting the compound (H) and p,p'-dimethoxytritylchloride in a solvent such as pyridine in the presence of a cosolvent if necessary at a temperature between 0° C. and 100° C. for 5 minutes to 100 hours.

Examples of the cosolvent include methanol, ethanol, dichloromethane, chloroform, 1,2-dichloroethane, toluene, ethyl acetate, acetonitrile, diethyl ether, tetrahydrofuran, 1,2-dimethoxyethane, dioxane, N,N-dimethylformamide (DMF), N,N-dimethylacetamide, N-methylpyrrolidone, triethylamine, N,N-diisopropylethylamine, and water, and one of these or a mixture of these can be used.

(Step 9)

A compound (J) can be produced by reacting the compound (I) in a solvent at a temperature between 0° C. and a boiling point of the solvent to be used for 10 minutes to 10 days with 1 to 10 equivalents of an additive.

Examples of the solvent include dichloromethane, acetonitrile, toluene, ethyl acetate, THF, 1,4-dioxane, DMF, DMA, and NMP, and one of these or a mixture of these can be used.

Examples of the additive include tetrabutylammonium fluoride and triethylamine trihydrofluoride, and one of these or a mixture of these can be used.

(Step 10)

A compound (K) can be produced by reacting the compound (J) and succinic anhydride in a solvent in the presence of 1 to 30 equivalents of a base at a temperature between room temperature and 200° C. for 5 minutes to 100 hours.

Examples of the solvent include methanol, ethanol, dichloromethane, chloroform, 1,2-dichloroethane, toluene, ethyl acetate, acetonitrile, diethyl ether, tetrahydrofuran, 1,2-dimethoxyethane, dioxane, N,N-dimethylformamide (DMF), N,N-dimethylacetamide, N-methylpyrrolidone, pyridine, and water, and one of these or a mixture of these can be used.

Examples of the base include cesium carbonate, potassium carbonate, potassium hydroxide, sodium hydroxide, sodium methoxide, potassium tert-butoxide, triethylamine, diisopropylethylamine, N-methylmorpholine, pyridine, 1,8-diazabicyclo[5.4.0]-7-undecene (DBU), and N,N-dimethyl-4-aminopyridine (DMAP), and one of these or a mixture of these can be used.

(Step 11)

A compound (L) can be produced by reacting the compound (K) and a solid support having an aminized end in the absence of a solvent or in a solvent in the presence of 1 to 30 equivalents of a base, a condensing agent, and 0.01 to 30 equivalents of an additive if necessary at a temperature between room temperature and 200° C. for 5 minutes to 100 hours, and then reacting the resultant in an acetic anhydride/pyridine solution at a temperature between room temperature and 200° C. for 5 minutes to 100 hours.

Examples of the solvent include those mentioned as the examples in Step 4.

Examples of the base include cesium carbonate, potassium carbonate, potassium hydroxide, sodium hydroxide, sodium methoxide, potassium tert-butoxide, triethylamine, diisopropylethylamine, N-methylmorpholine, pyridine, 1,8-diazabicyclo[5.4.0]-7-undecene (DBU), and N,N-dimethyl-4-aminopyridine (DMAP), and one of these or a mixture of these can be used.

Examples of the condensing agent include 1,3-dicyclohexanecarbodiimide (DCC), 1-ethyl-3-(3-dimethylaminopropyl)carbodiimide hydrochloride (EDC), carbonyldiimidazole, benzotriazole-1-yloxytris(dimethylamino) phosphonium hexafluorophosphate, (benzotriazole-1-yloxy) tripyrrolidinophosphonium hexafluorophosphate, 0-(7-azabenzotriazole-1-yl)-N,N,N',N'-tetramethyluronium hexafluorophosphate (HATU), 0-(benzotriazole-1-yl)-N,N,N',N'-tetramethyluronium hexafluorophosphate (HBTU), and 2-chloro-1-methylpyridinium iodide.

Examples of the additive include 1-hydroxybenzotriazole (HOBt) and 4-dimethylaminopyridine (DMAP), and one of these or a mixture of these can be used.

The solid support is not especially limited as long as an aminized solid support known to be used in solid phase synthesis is used, and examples include solid supports such as CPG (controlled pore glass) modified with a long chain alkylamino group, and PS (polystyrene resin).

For example, as long chain alkylamine controlled pore glass (LCAA-CPG), a commercially available product can be used.

(Step 12)

A compound (M) can be produced by elongating a corresponding nucleotide chain with the compound (L) used by a known oligonucleotide chemical synthesis method, and then performing removal from a solid phase, deprotection of a protecting group, and purification.

For performing the removal from a solid phase and deprotection, after the oligonucleotide chemical synthesis, the resultant is treated with a base in a solvent or in the absence of a solvent at a temperature between −80° C. and 200° C. for 10 seconds to 72 hours.

Examples of the base include ammonia, methylamine, dimethylamine, ethylamine, diethylamine, isopropylamine, diisopropylamine, piperidine, triethylamine, ethylenediamine, 1,8-diazabicyclo[5.4.0]-7-undecene (DBU), and potassium carbonate, and one of these or a mixture of these can be used.

Examples of the solvent include water, methanol, ethanol, and THF, and one of these or a mixture of these can be used.

The purification of the oligonucleotide can be performed with a C18 reverse phase column or an anion exchange column, and preferably with a combination of the two methods described above.

A concentration of a nucleic acid complex obtained after the purification is preferably 90% or more, and more preferably 95% or more.

(Step 13)

A compound (N) can be produced by causing a reaction using the compound (M) in a buffer in the presence of 1 to 1000 equivalents of a compound (O) at a temperature between room temperature and 100° C. for 5 minutes to 100 hours.

Examples of the buffer include acetate buffer, Tris buffer, citrate buffer, phosphate buffer, and water, and one of these or a mixture of these can be used.

As the compound (O), a commercially available product can be used.

A method for producing a compound (W), that is, a polynucleotide unit on the 3' end side, to be used in the linking is as follows:

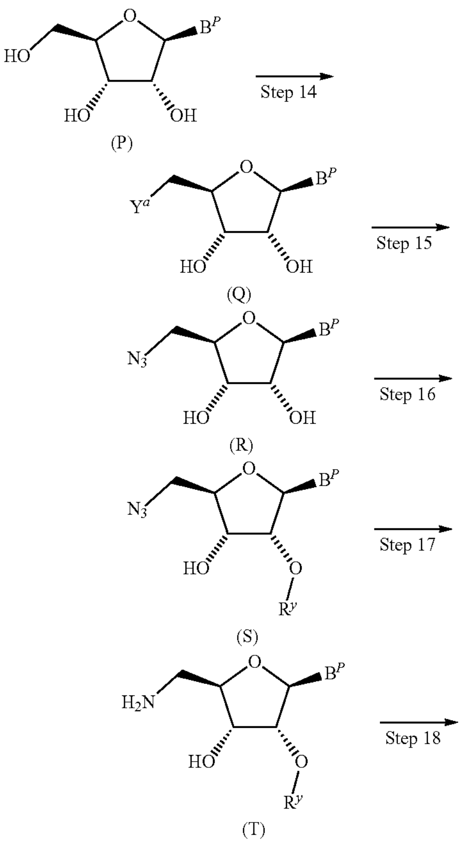

(P)
(Q)
(R)
(S)
(T)

-continued

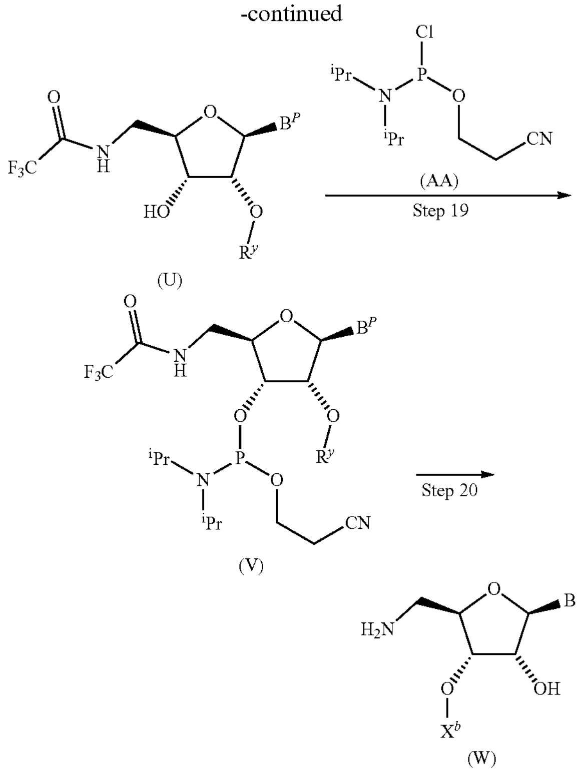

(U)
(AA)
(V)
(W)

wherein BP represents a base optionally protected by a protecting group, B represents a base, $R^7$ represents a protecting group, such as a tert-butyldimethylsilyl group, or a triethylsilyl group, Yc represents, for example, a chlorine atom, a bromine atom, or a tosylate group, and $X^b$ represents a nucleic acid sequence. If a plurality of Bs are contained in a molecule, these Bs may be the same or different.

(Step 14)

A compound (Q) can be produced by reacting a compound (P) in a solvent in the presence of an additive and a base at a temperature between 0° C. and a boiling point of the solvent to be used for 10 seconds to 3 days.

Examples of the solvent include a dichloromethane, acetonitrile, toluene, ethyl acetate, THF, 1,4-dioxane, DMF, DMA, and NMP, and one of these or a mixture of these can be used.

Examples of the additive include p-toluenesulfonic acid anhydride, tosyl chloride, thionyl chloride, and oxalyl chloride, and one of these or a mixture of these can be used.

Examples of the base include pyridine, triethylamine, N-ethyl-N,N-diisopropylamine, and potassium carbonate, and one of these or a mixture of these can be used.

As the compound (P), a commercially available product can be used.

(Step 15)

A compound (R) can be produced by reacting the compound (Q) in a solvent in the presence of an azidizing agent, and a base if necessary, at a temperature between room temperature and a boiling point of the solvent to be used for 10 seconds to 3 days.

Examples of the solvent include dichloromethane, acetonitrile, toluene, ethyl acetate, THF, 1,4-dioxane, DMF, DMA, and NMP, and one of these or a mixture of these can be used.

An example of the azidizing agent includes sodium azide.

Examples of the base include pyridine, triethylamine, N-ethyl-N,N-diisopropylamine, and potassium carbonate, and one of these or a mixture of these can be used.

(Step 16)

A compound (S) can be produced by reacting the compound (R) in a solvent in the presence of a silylating agent and a base at a temperature between room temperature and a boiling point of the solvent to be used for 10 seconds to 3 days.

Examples of the solvent include dichloromethane, acetonitrile, toluene, ethyl acetate, THF, 1,4-dioxane, DMF, DMA, and NMP, and one of these or a mixture of these can be used.

Examples of the silylating agent include tert-butyldimethylsilyl chloride, tert-butyldimethylsilyl triflate, and triethylsilyl chloride.

Examples of the base include pyridine, triethylamine, N-ethyl-N,N-diisopropylamine, potassium carbonate, potassium hydroxide, sodium hydroxide, sodium methoxide, potassium tert-butoxide, triethylamine, diisopropylethylamine, N-methylmorpholine, pyridine, 1,8-diazabicyclo[5.4.0] undecene (DBU), and N,N-dimethyl-4-aminopyridine (DMAP), and one of these or a mixture of these can be used.

(Step 17)

A compound (T) can be produced by reacting the compound (S) in a solvent with a reductant added at a temperature between room temperature and a boiling point of the solvent to be used for 10 seconds to 3 days.

Examples of the solvent include methanol, ethanol, dichloromethane, chloroform, 1,2-dichloroethane, toluene, ethyl acetate, acetonitrile, diethyl ether, tetrahydrofuran, 1,2-dimethoxyethane, dioxane, N,N-dimethylformamide (DMF), N,N-dimethylacetamide, N-methylpyrrolidone, triethylamine, N,N-diisopropylethylamine, acetic acid, and water, and one of these or a mixture of these can be used.

Examples of the reductant include sodium borohydride, sodium cyanoborohydride, lithium borohydride, sodium triacetoxyborohydride, and palladium carbon used in a hydrogen atmosphere.

(Step 18)

A compound (U) can be produced with the compound (T) used in the same manner as in Step 7.

(Step 19)

A compound (V) can be produced by reacting the compound (U) and a compound (AA) in a solvent in the presence of a base at a temperature between 0° C. and 100° C. for 10 seconds to 24 hours.

Examples of the solvent include dichloromethane, acetonitrile, toluene, ethyl acetate, THF, 1,4-dioxane, DMF and NMP, and one of these or a mixture of these can be used.

Examples of the base include triethylamine, N,N-diisopropylethylamine, and pyridine, and one of these or a mixture of these can be used.

As the compound (AA), a commercially available product can be used.

(Step 20)

A compound (W) can be produced with the compound (V) used in the same manner as in Step 12.

When the polynucleotide of the present embodiment is produced by linking a plurality of polynucleotide units, some of the polynucleotide units may be a polynucleotide produced by IVT. A method for linking polynucleotides produced by IVT is not especially limited, and examples include the enzymatic method and the chemical synthesis method described above. An example of a method for producing a polynucleotide unit by IVT includes a method in which an RNA is transcribed from a template DNA having a promoter sequence by using an RNA polymerase. More specific examples of known IVT include methods described in the following literatures:

RNA, Methods in Molecular Biology (Methods and Protocols), Vol. 703, Chapter 3 (2011);

Cardiac Gene Therapy: Methods in Molecular Biology (Methods and Protocols), Vol. 1521, Chapter 8 (2016); and Journal of Molecular Biology, Vol. 249, p. 398-408 (1995).

Examples of the template DNA to be used in IVT include one produced by chemical synthesis, one produced by polymerase chain reaction, a plasmid DNA, and one produced by linearizing a plasmid DNA with a restriction enzyme, and one of these or a mixture of these can be used. Examples of the RNA polymerase include T3RNA polymerase, T7RNA polymerase, and SP6RNA polymerase, and one of these or a mixture of these can be used. Ribonucleoside triphosphate used in the transcription may be modified, or a mixture of a plurality of ribonucleoside triphosphates can be used. As described in Cardiac Gene Therapy: Methods in Molecular Biology (Methods and Protocols), Vol. 1521, Chapter 8 (2016), a compound such as m7G(5')ppp(5')G (manufactured by TriLink Biotechnologies, Catalog No. S1404) or Anti Reverse Cap Analog, 3'-O-Me-m7G(5')ppp(5')G (manufactured by TriLink Biotechnologies, Catalog No. N-7003) can be used for imparting the 5' cap structure. As described in Journal of Molecular Biology, Vol. 249, p. 398-408 (1995), the 5' end or the 3' end of an RNA can be cut after the transcription by inserting a sequence of Hepatitis delta virus (HDV) ribosome or the like into the template DNA.

<Pharmaceutical Composition>

One embodiment of the present invention relates to a pharmaceutical composition containing the polynucleotide. When the pharmaceutical composition of the present embodiment is administered to a patient having a disease, the polynucleotide is translated to synthesize a polypeptide encoded by the polynucleotide, and thus, the disease is treated.

Although not especially limited, a method for treating a disease characterized in that the function or activity of a specific protein is lost or abnormal by compensating the function or activity by the polypeptide translated from the polynucleotide is provided. Alternatively, a treatment method for artificially controlling immune response by causing a foreign antigen peptide and an analog thereof to express in a living body by the polypeptide translated from the polynucleotide is provided. Besides, the function, the differentiation, the growth and the like of a cell can be artificially controlled and modified by causing, by the polypeptide translated from the polynucleotide, a specific protein present in a living body such as a transcription factor, or a polypeptide essentially not present in a living body to express in a living body, and thus, a treatment method, for a disease characterized in that a tissue or a cell is damaged, or is deteriorated or becomes abnormal in the function or activity, for recovering the function of the tissue or cell is also provided.

The disease is not especially limited, and examples include cancers and proliferative diseases, infectious diseases and parasitic diseases, diseases of blood and hematopoietic organs, autoimmune disease, diseases of internal secretion, nutrient, and metabolism (including inborn error of metabolism), mental and nervous system diseases, diseases of the skin and subcutaneous tissues, eye disease, ear disease, respiratory system diseases, digestive system diseases, diseases of the kidney, the urinary tract and the reproductive system, cardiovascular diseases, cerebrovascular diseases, diseases of the musculoskeletal system and connective tissues, spontaneous abortion, perinatal disorders, congenital malformation abnormality, acquired injuries, and addiction.

The pharmaceutical composition may be administered in a prescribed formulation form. An example of the formulation includes a liquid dosage form for oral administration or parenteral administration, and examples of the liquid dosage form include a pharmaceutically acceptable emulsion, a microemulsion, a solution, a suspension, a syrup, and an elixir. The liquid dosage form may contain, in addition to the active ingredient, an inactive diluent (such as water or another solvent) generally used in this technical field, a solubilizing agent and an emulsifier (such as ethyl alcohol, isopropyl alcohol, ethyl carbonate, ethyl acetate, benzyl alcohol, benzyl benzoate, propylene glycol, 1,3-butylene glycol, dimethylformamide, an oil (particularly, an oil of cottonseed, peanuts, corn, germ, olive, castor-oil plant, or sesame), glycerol, tetrahydrofurfuryl alcohol, polyethylene glycol, and a sorbitan fatty acid ester, and a mixture of these). A formulation for oral administration may contain at least any one of an adjuvant (such as a humectant, an emulsifier, or a suspending agent), a sweetening agent, a flavor and a flavoring agent. A formulation for parenteral administration may contain a solubilizing agent (such as Cremophor®, an alcohol, an oil, a modified oil, glycol, polysorbate, cyclodextrin, a polymer, or a combination of these).

Examples of a method for administering the pharmaceutical composition include lymph node topical administration, intratumoral topical administration, intramuscular administration, intradermal administration, subcutaneous administration, intratracheal administration, intrathecal administration, intraventricular administration, intraocular administration, intratympanic administration, catheter administration to the coronary artery, catheter administration to the hepatic portal vein, catheter administration to the heart muscle, transurethral catheter administration, and intravenous administration.

The pharmaceutical composition may contain, in addition to the polynucleotide, an optional component. Examples of the optional component include one or more pharmaceutically acceptable additives selected from a solvent, an aqueous solvent, a nonaqueous solvent, a dispersion medium, a diluent, a dispersion, a suspension aid, a surfactant, a tonicity agent, a thickener, an emulsifier, a preservative, a lipid, a lipidoid liposome, a lipid nanoparticle, a core-shell nanoparticle, a polymer, a lipoplexe, a peptide, a protein, a cell, a hyaluronidase, and a mixture of these.

EXAMPLES

Now, the present invention will be described in more detail with reference to examples and reference examples, and it is noted that the technical field of the present invention is not limited to these.

As reagents used in synthesis of compounds, those purchased from Sigma Aldrich Co., Tokyo Chemical Industry Co., Ltd., Wako Pure Chemical Industries Ltd., and Kanto Chemical Co., Inc. were used without purification. An anhydrous solvent was prepared by drying a solvent on activated molecular sieve 4 Angstrom for 12 hours, or a commercially available anhydrous grade solvent was used. A reaction was tracked by thin layer silica gel chromatography (silica gel 70F254 TLC plate-Wako, Wako Pure Chemical Industries Ltd.). For purification of a compound, silica gel 60 N for flash chromatography (spherical, neutral, particle size: 40 to 50 μm) (Kanto Chemical Co., Inc.) was used. NMR was measured with JEOL ECS 400 MHz (JEOL Ltd.) with a deuteration solvent ($CDCl_3$, $CD_3OD$, DMSO-$d_6$) (Kanto Chemical Co., Inc.) used as a measurement solvent. Data of NMR thus obtained was analyzed with software of JEOL Delta (JEOL Ltd.), and a chemical shift value was corrected by a residual signal ($CDCl_3$: 7.26, $CD_3OD$: 3.31, DMSO-$d_5$: 2.50) (Organometallics 2010, 29, 2176-2179) in the deuteration solvent. Data of $^1H$ NMR was shown as a chemical shift value (δ), an integrated value (H), a signal splitting pattern, and a coupling constant (Hz) (s: singlet, d: doublet, t: triplet, sept.: septet, m: multiplet, br.: broad). High resolution mass spectrometry was measured with micrOTOF-QII ESI (Bruker Daltonics), and an accurate mass was corrected with ESI TUNING MIX (Agilent Technologies) used as internal standard.

Synthesis of a compound 12 used as a raw material of a polynucleotide was performed in accordance with the following scheme:

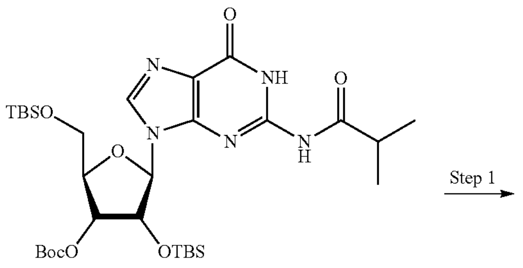

3

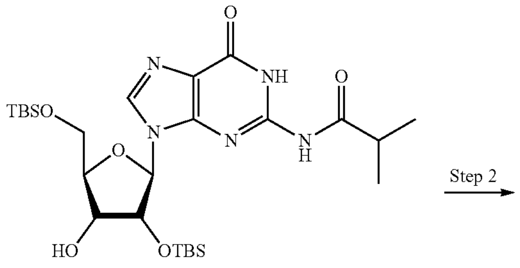

4

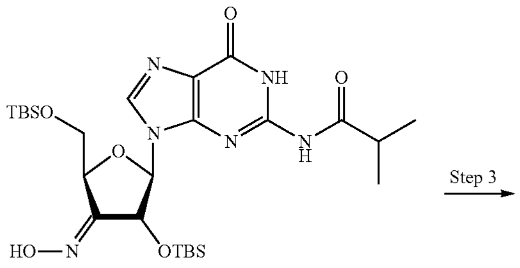

5

-continued

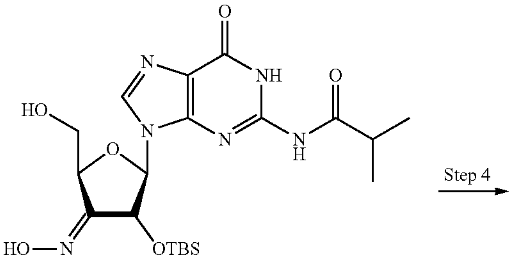

6

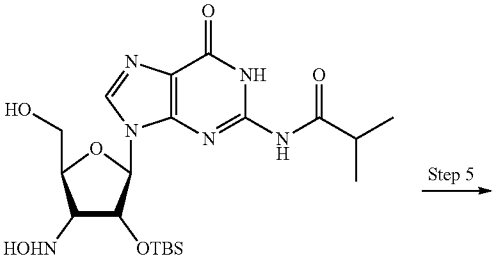

7

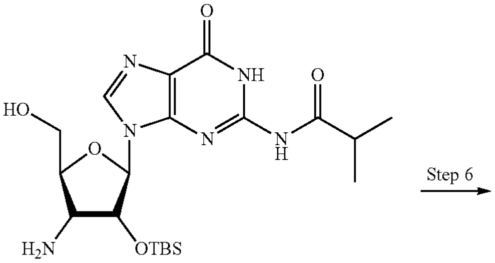

8

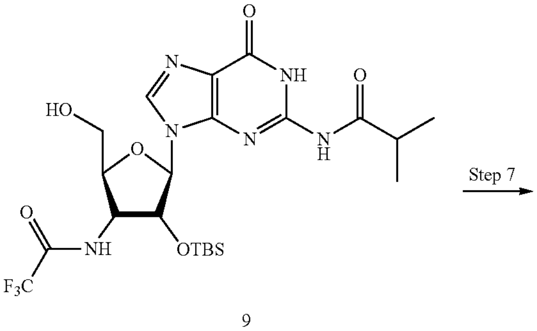

9

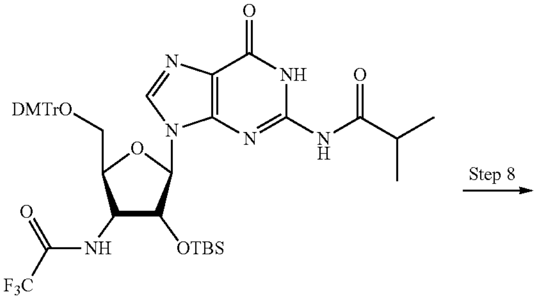

10

-continued

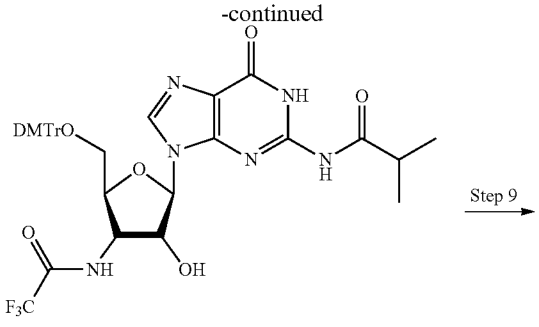

11

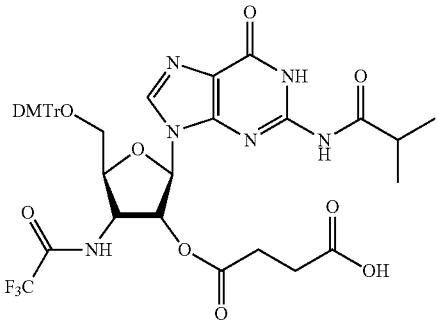
12

Step 1 Synthesis of Compound 4

N-(9-((2R,3S,4S,5R)-3-(tert-butyldimethylsilyloxy)-5-((tert-butyldimethylsilyloxy)methyl)-4-hydroxy-tetrahydrofuran-2-yl)-6-oxo-6,9-dihydro-1H-purin-2-yl)isobutyramide A compound 3 obtained by a method described in a literature (J. Am. Chem. Soc., 1999, 121, 5661-5665) or the like was used to be dissolved in 1,2-dichlorobenzene (2.0 mL), and the resultant was stirred on an oil bath (160° C.) for 4 hours. The resultant reaction solution was returned to room temperature, and purified, without concentration, by flash column chromatography (neutral silica gel, dichloromethane/methanol=40:1) to obtain a compound 4 in the form of a white solid (0.31 g, yield: 53%).

$^1$H NMR (400 MHz, $CDCl_3$) δ 12.01 (1H, s), 8.50 (1H, s), 8.07 (1H, s), 5.86 (1H, d, J=6.0 Hz), 4.47 (1H, s), 4.24-4.23 (1H, m), 4.22-4.21 (1H, m), 3.93 (1H, dd, J=11.6, 2.0 Hz), 3.82 (1H, dd, J=11.6, 2.0 Hz), 2.66 (1H, sept., J=6.8 Hz), 1.27 (3H, d, J=6.8 Hz), 1.25 (3H, d, J=6.8 Hz), 0.93 (9H, s), 0.82 (9H, s), 0.13 (3H, s), 0.12 (3H, s), −0.07 (3H, s), −0.20 (3H, s)

$^{13}$C NMR (100 MHz, $CDCl_3$) δ 179.0, 155.7, 148.5, 148.7, 147.8, 136.8, 121.0, 87.4, 85.4, 77.6, 71.8, 63.6, 36.2, 25.9, 25.4, 19.1, 18.7, 18.3, 17.8, −5.3, −5.4, −5.5, −5.6

ESI-HRMS: calcd for $C_{26}H_{48}N_5O_6Si_2$ 582.31[M+H]$^+$, found: 582.31 [M+H]$^+$.

Step 2 Synthesis of Compound 5

N-(9-((2R,35,55)-3-(tert-butyldimethylsilyloxy)-5-((tert-butyldimethylsilyloxy)methyl)-4-(hydroxy-imino)-tetrahydrofuran-2-yl)-6-oxo-6,9-dihydro-1H-purin-2-yl)isobutyramide Molecular sieve 3 Angstrom (in the shape of a powder) (258 mg) was added to a solution of chromic acid (129 mg, 1.29 mmol) in anhydrous dichloromethane (2.0 mL), followed by cooling on an ice bath. Anhydrous pyridine (207 μL, 1.29 mmol) was added in a dropwise manner to the resultant solution under stirring, followed by stirring on an ice bath. After 30 minutes, acetic anhydride (122 μL, 1.29 mmol) was added thereto in a dropwise manner, followed by stirring on an ice bath. After 30 minutes, a solution of the compound 4 (250 mg, 0.43 mmol) in dichloromethane (1.3 mL) was added thereto in a dropwise manner, followed by stirring at room temperature for 2 hours. After confirming disappearance of the raw material by thin layer chromatography, the resultant reaction solution was diluted with ethyl acetate, and filtered through a silica pad (with a thickness of 2 cm), and the resultant filtrate was concentrated under reduced pressure to obtain a colorless solid. The thus obtained crude product 4' was directly used in the following reaction.

Hydroxylamine hydrochloride (299 mg, 4.30 mmol) was added to a solution of the crude product 4' (as 0.43 mmol) in pyridine (4 mL), followed by stirring at room temperature. After 24 hours, the resultant reaction solution was concentrated under reduced pressure, and water was added to the resultant residue, followed by extraction with ethyl acetate. An organic layer was washed with a saturated saline solution, and dried over anhydrous sodium sulfate. The organic layer was concentrated under reduced pressure, and the residue was purified by flash column chromatography (neutral silica gel, dichloromethane/methanol=40:1) to obtain a compound 5 in the form of a white solid (255 mg, yield for two steps: 68%).

$^1$H NMR (400 MHz, $CDCl_3$) δ 12.14 (1H, s), 9.27 (1H, s), 8.78 (1H, s), 8.11 (1H, s), 5.78 (1H, d, J=7.6 Hz), 5.09 (1H, s), 4.92 (1H, d, J=7.2 Hz), 4.14 (1H, d, J=11.4 Hz), 3.92 (1H, d, J=11.4 Hz), 2.79-2.74 (1H, m), 1.27-1.21 (6H, m), 0.91 (9H, s), 0.71 (9H, s), 0.10 (3H, s), 0.07 (3H, s), −0.10 (3H, s), −0.23 (3H, s)

$^{13}$C NMR (100 MHz, $CDCl_3$) δ 178.9, 157.8, 155.6, 148.7, 147.8, 136.8, 120.8, 87.5, 86.5, 62.2, 36.3, 25.9, 25.5, 25.2, 19.1, 18.8, 18.3, 18.0, −5.0, −5.5, −5.6, −5.7

ESI-HRMS: calcd for $C_{26}H_{47}N_6O_6Si_2$ 595.31[M+H]$^+$, found: 595.31[M+H]$^+$.

Step 3 Synthesis of Compound 6

N-(9-((2R,3S,5S)-3-(tert-butyldimethylsilyloxy)-4-(hydroxyimino)-5-(hydroxymethyl)-tetrahydrofuran-2-yl)-6-oxo-6,9-dihydro-1H-purin-2-yl)isobutyramide A 90% trifluoroacetic acid aqueous solution (1.0 mL) cooled on ice was added to the compound 5 (129 mg, 0.22 mmol), followed by stirring on an ice bath for 30 minutes. The resultant reaction solution was concentrated under reduced pressure, and the thus obtained residue was azeotroped with toluene and water (1:1, v/v) three times under reduced pressure. The thus obtained residue was purified by flash column chromatography (neutral silica gel, dichloromethane/methanol=50:1 to 40:1) to obtain a compound 6 in the form of a white solid (96 mg, yield: 92%).

$^1$H NMR (400 MHz, $CD_3OD$) δ 8.36 (1H, s), 5.87 (1H, d, J=7.6 Hz), 5.18 (1H, dd, J=7.6, 2.0 Hz), 5.02 (1H, d, J=2.0 Hz), 4.11 (1H, dd, J=12.0, 2.0 Hz), 3.92 (1H, d, J=12.0, 2.0 Hz), 2.71 (1H, sept., J=7.2 Hz), 1.21 (6H, d, J=7.2 Hz), 0.72 (9H, s), 0.00 (3H, s), −0.16 (3H, s)

$^{13}$C NMR (100 MHz, $CD_3OD$) δ 181.8, 157.4, 156.8, 151.0, 150.0, 139.8, 121.3, 88.4, 79.7, 76.5, 61.6, 36.9, 25.9, 19.4, 19.2, −4.5, −5.5

ESI-HRMS: calcd for $C_{20}H_{32}N_6NaO_6Si$, 503.21[M+Na]$^+$, found: 503.20[M+Na]$^+$.

Step 4 Synthesis of Compound 7

N-(9-((2R,3S,4S,5S)-4-amino-3-(tert-butyldimethylsilyloxy)-5-(hydroxymethyl)-tetrahydrofuran-2-yl)-6-oxo-6,9-dihydro-1H-purin-2-yl)isobutyramide Sodium borohydride (15 mg, 0.38 mmol) was added to a solution of the compound 6 (93 mg, 0.19 mmol) in acetic acid (1.9 mL), followed by stirring at room temperature for 1 hour. After confirming disappearance of the raw material by thin layer chromatography, the resultant reaction solution was concentrated under reduced pressure, and the thus obtained residue was dissolved in ethyl acetate, washed with a saturated saline solution, and dried over anhydrous sodium sulfate. An organic layer was concentrated under reduced pressure, and the thus obtained residue was purified by flash column chromatography (neutral silica gel, dichloromethane/methanol: 20:1) to obtain a compound 7 in the form of a white solid (51 mg, yield: 55%).

$^1$H NMR (400 MHz, $CD_3OD$) δ 8.34 (1H, s), 6.06 (1H, d, J=6.0 Hz), 4.75 (1H, t, J=6.4 Hz), 4.27 (1H, d, J=2.8 Hz), 3.86 (1H, dd, J=12.4, 2.0 Hz), 3.73 (1H, d, J=12.4, 2.0 Hz), 3.62-3.60 (1H, m), 2.71 (1H, sept., J=6.8 Hz), 1.21 (6H, d, J=6.8 Hz), 0.82 (9H, s), −0.02 (3H, s), −0.23 (3H, s)

$^{13}$C NMR (100 MHz, $CD_3OD$) δ 181.8, 157.4, 150.8, 149.8, 139.6, 139.4, 121.1, 89.7, 84.5, 77.7, 65.4, 65.2, 36.9, 26.0, −5.2, −5.3

ESI-HRMS: calcd for $C_{20}H_{35}N_6O_6Si$, 483.24[M+H]$^+$, found: 483.23[M+H]$^+$.

Step 5 Synthesis of Compound 8

N-(9-((2R,3S,4S,5S)-4-amino-3-(tert-butyldimethylsilyloxy)-5-(hydroxymethyl)-tetrahydrofuran-2-yl)-6-oxo-6,9-dihydro-1H-purin yl)isobutyramide 10% Palladium carbon (20 mg) was added to a 90% acetic acid aqueous solution (1.5 mL) of the compound 7 (50 mg, 0.10 mmol), followed by stirring at room temperature under a hydrogen atmosphere for 18 hours. After confirming disappearance of the raw material by thin layer chromatography, the resultant reaction solution was diluted with methanol, and palladium carbon was removed by celite filtration. The resultant filtrate was concentrated under reduced pressure, and the thus obtained residue was purified by flash column chromatography (neutral silica gel, dichloromethane/methanol=15:1 to 10:1) to obtain a compound 8 in the form of a white solid (41 mg in terms of acetate, yield: 75%).

$^1$H NMR (400 MHz, $CD_3OD$) δ 8.32 (1H, s), 5.99 (1H, s), 4.60 (1H, s), 3.95-3.68 (4H, m), 2.73 (1H, br. s), 1.22 (6H, br. s), 0.05 (3H, s), −0.06 (3H, s)

ESI-HRMS: calcd for $C_{20}H_{34}N_6NaO_5Si$, 489.2258[M+Na]$^+$, found: 489.2231[M+Na]$^+$.

Step 6 Synthesis of Compound 9

N-(9-((2R,3S,4R,5S)-3-(tert-butyldimethylsilyloxy)-5-(hydroxymethyl)-4-(2,2,2-trifluoroacetamido)-tetrahydrofuran-2-yl)-6-oxo-6,9-dihydro-1H-purin-2-yl)isobutyramide Ethyl trifluoroacetate (0.76 mL) was added to a methanol solution (0.76 mL) of the compound 8 (40 mg, 0.076 mmol)

of known literature (WO2017/123669) and triethylamine (45 L, 0.38 mmol), followed by stirring at room temperature for 24 hours. After confirming disappearance of the raw material by thin layer chromatography, the resultant reaction solution was concentrated under reduced pressure, and the thus obtained residue was purified by flash column chromatography (neutral silica gel, dichloromethane/methanol=20:1 to 12:1) to obtain a compound 9 in the form of a white solid (12 mg, yield: 28%).

$^1$H NMR (400 MHz, $CDCl_3$) δ 12.26 (1H, s), 10.11 (1H, s), 7.76 (1H, s), 7.26 (1H, d, J=3.6 Hz), 5.71 (1H, d, J=3.6 Hz), 4.98 (1H, dd, J=6.8 Hz), 4.78 (1H, dd, J=6.8, 3.6 Hz), 4.21 (1H, d, J=6.8 Hz), 4.03 (1H, dd, J=11.2 Hz), 3.82 (1H, dd, J=11.2 Hz), 2.79 (1H, sept., J=6.8 Hz), 1.26 (3H, d, J=6.8 Hz), 1.24 (3H, d, J=6.8 Hz), 0.85 (9H, s), −0.01 (3H, s), −0.11 (3H, s)

$^{13}$C NMR (100 MHz, $CDCl_3$) δ 179.8, 158.0, 157.7, 157.3, 156.9, 155.2, 148.3, 147.3, 138.6, 122.0, 120.0, 117.1, 114.2, 111.3, 91.6, 83.7, 74.5, 61.3, 51.0, 36.1, 25.2, 18.9, 17.7, −5.0, −5.4

ESI-HRMS: calcd for $C_{22}H_{33}F_3N_6NaO_6Si$, 585.21[M+Na]$^+$, found: 585.21[M+Na]$^+$.

Step 7 Synthesis of Compound 10

N-(9-((2R,3S,4R,5S)-5-((bis(4-methoxyphenyl)(phenyl)methoxy)methyl)-3-(tert-butyldimethylsilyloxy)-4-(2,2,2-trifluoroacetamido)-tetrahydrofuran-2-yl)-6-oxo-6,9-dihydro-1H-purin-2-yl)isobutyramide Dimethoxytrityl chloride (18 mg, 0.053 mmol) was added to a solution of the compound 9 (10 mg, 0.017 mmol) in anhydrous pyridine (1 mL), followed by stirring at room temperature for 1.5 hours. Thereafter, dimethoxytrityl chloride (18 mg, 0.053 mmol) was further added thereto, followed by stirring at room temperature for 30 minutes. After confirming disappearance of the raw material by thin layer chromatography, methanol (1 mL) was added to the resultant reaction solution, followed by concentration under reduced pressure. The resultant residue was dissolved in ethyl acetate, and was washed with water, and then with a saturated saline solution. An organic layer was dried over anhydrous sodium sulfate, and a residue obtained by concentration under reduced pressure of the resultant was purified by flash column chromatography (neutral silica gel, hexane/ethyl acetate=5:1 to 2:1) to obtain a compound 10 in the form of a white solid (15.2 mg, yield: 99%).

$^1$H NMR (400 MHz, $CDCl_3$) δ 11.99 (1H, s), 10.11 (1H, s), 8.07 (1H, s), 7.81 (1H, s), 7.45 (2H, dd, J=8.2, 2.0 Hz), 7.32 (4H, dd, J=9.2, 3.6 Hz), 7.24-7.29 (3H, m), 7.01 (1H, d, J=7.2 Hz), 6.76 (4H, J=9.2, 3.6 Hz), 5.71 (1H, d, J=4.2 Hz), 5.16 (1H, dd, J=6.4, 4.2 Hz), 4.20-4.17 (1H, m), 3.76 (3H, s), 3.75 (3H, s), 3.56 (1H, dd, J=11.2, 2.8 Hz), 3.22 (1H, dd, J=11.2, 2.8 Hz), 1.82 (1H, d, J=6.8 Hz), 0.97 (3H, d, J=6.8 Hz), 0.68 (9H, s), 0.79 (3H, d, J=6.8 Hz), 0.04 (3H, s), −0.06 (3H, s)

$^{13}$C NMR (100 MHz, $CDCl_3$) δ 171.2, 158.7, 158.0, 157.6, 157.2, 156.8, 155.4, 147.6, 147.2, 144.8, 139.2, 135.9, 135.4, 130.0, 127.9, 127.1, 122.6, 120.0, 117.0, 114.1, 111.2, 90.1, 86.3, 81.7, 73.4, 62.4, 60.4, 55.2, 51.4, 36.1, 25.4, 18.4, 17.8, −5.0, −5.3

ESI-HRMS: calcd for $C_{43}H_{52}F_3N_6O_8Si$, 865.36[M+H]$^+$, found: 865.35[M+H]$^+$.

Step 8 Synthesis of Compound 11

N-(9-((2R,3S,4S,5S)-5-((bis(4-methoxyphenyl)(phenyl)methoxy)methyl)-3-hydroxy-4-(2,2,2-trifluoroacetamido)-tetrahydrofuran-2-yl)-6-oxo-6,9-dihydro-1H-purin-2-yl)isobutyramide Tetrabutylammonium fluoride (1M tetrahydrofuran solution, 19 μL, 0.019 mmol) was added to a solution of the compound 10 (14 mg, 0.016 mmol) in tetrahydrofuran (1 mL), followed by stirring at room temperature for 1 hour. After confirming disappearance of the raw material by thin layer chromatography, the resultant reaction solution was concentrated under reduced pressure. The thus obtained residue was purified by flash column chromatography (neutral silica gel, dichloromethane/methanol=30:1 to 15:1) to obtain a compound 11 in the form of a white solid (10.8 mg, yield: 83%).

$^1$H NMR (400 MHz, $CDCl_3$) δ 12.12 (1H, br. s), 8.76 (1H, br. s), 7.74 (1H, s), 7.81 (1H, s), 7.68 (1H, d, J=5.4 Hz), 7.48 (2H, d, J=7.6 Hz), 7.37 (2H, d, J=9.2 Hz), 7.34 (2H, d, J=9.2 Hz), 7.25-7.21 (2H, m), 7.17 (1H, t, J=7.2 Hz), 6.81 (2H, d, J=9.2 Hz), 6.78 (2H, d, J=9.2 Hz), 5.80 (1H, d, J=4.0 Hz), 5.35 (1H, br. s), 5.08 (1H, dd, J=12.4, 6.4 Hz), 4.30-4.29 (1H, m), 3.76 (3H, s), 3.74 (3H, s), 3.57-3.53 (1H, m), 3.29-3.26 (1H, m), 1.84-1.57 (1H, m), 0.94 (3H, d, J=6.8 Hz), 0.68 (3H, d, J=6.8 Hz)

$^{13}$C NMR (100 MHz, $CDCl_3$) δ 179.4, 158.6, 158.4, 158.0, 157.6, 157.3, 147.8, 147.2, 144.8, 139.4, 136.3, 135.7, 130.1, 129.9, 128.1, 128.0, 127.0, 121.0, 120.0, 117.1, 114.2, 111.3, 91.2, 86.1, 82.5, 71.5, 62.7, 55.1, 51.2, 35.9, 18.5, 18.2

ESI-HRMS: calcd for $C_{37}H_{38}F_3N_6O_8$ 751.27[M+H]$^+$, found: 751.27 [M+H]$^+$.

Step 9 Synthesis of Compound 12

Succinic anhydride (0.24 g, 2.40 mmol) and dimethylaminopyridine (29 mg, 0.24 mmol) were added to a solution of the compound 11 (0.90 g, 1.20 mmol) and triethylamine (0.42 mL, 3.0 mmol) in acetonitrile (12 mL), followed by stirring at room temperature for 1 hour. After confirming disappearance of the raw material by thin layer chromatography, the resultant reaction solution was concentrated under reduced pressure. The resultant residue was dissolved in ethyl acetate, and was washed with a saturated sodium bicarbonate aqueous solution twice, and then with a saturated saline solution. An organic layer was dried over anhydrous sodium sulfate, and was concentrated under reduced pressure. The thus obtained residue was subjected to an azeotropic operation through concentration under reduced pressure with dichloromethane/methanol solution (1:1, v/v) to obtain a white foamy solid (1.11 g in terms of triethylamine salt, 97%). The thus obtained compound 12 was directly used in the following reaction.

The compound 12 can be synthesized by obtaining an intermediate 6 from the following starting material 13:

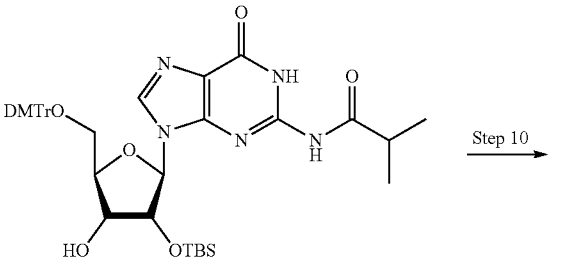

13

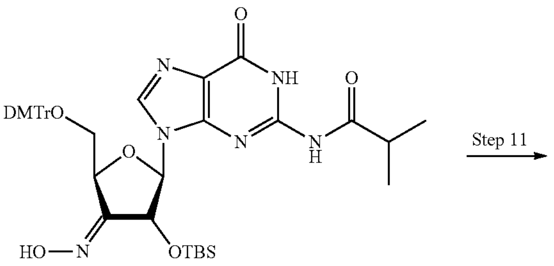

14

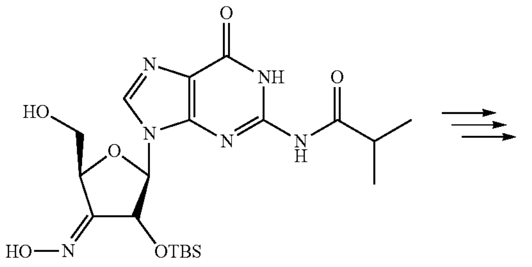

6

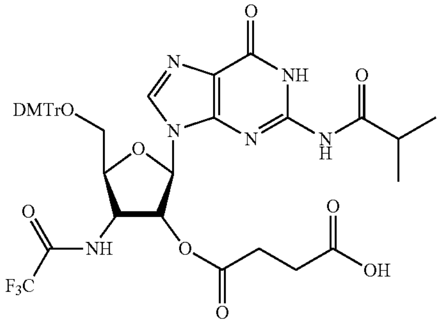

12

Step 10 Synthesis of Compound 14

N-(9-((2R,3R,5S)-5-((bis(4-methoxyphenyl)(phenyl)methoxy)methyl)-3-((tert-butyldimethylsilyl)oxy)-4-(hydroxyimino)tetrahydrofuran-2-yl)-6-oxo-6,9-dihydro-1H-purin-2-yl)isobutyramide Under an argon atmosphere, a compound 13 (manufactured by ChemGenes Corp., 5.0 g, 6.5 mmol) was dissolved in dehydrated dichloromethane (50 mL), followed by stirring with cooling on an ice bath. With cooling the resultant reaction solution, sodium bicarbonate (8.2 g, 97.3 mmol) and nor-AZADO (36 mg, 0.260 mmol) were added thereto, and iodo benzene diacetate (3.14 g, 9.73 mmol) was added thereto dividedly with attention paid to internal temperature increase, followed by stirring for 21 hours and 10 minutes with increasing the temperature up to room temperature. After confirming disappearance of the raw material, isopropyl alcohol (7.5 mL) was added to the reaction solution, followed by stirring for 4 hours (for quenching an excessive portion of the oxidant). The resultant reaction solution was added to ice water, chloroform was further added thereto for separation, and an aqueous layer was extracted again with chloroform. An organic layer was combined, the resultant was washed with water once and with a saturated saline solution once, and was dehydrated with anhydrous sodium sulfate. The desiccant was filtered, and the resultant filtrate was concentrated to obtain a crude product (9.01 g, containing a compound having a DMTr group partially deprotected) in the form of an orange solid.

Under an argon atmosphere, the crude product (9.01 g) was dissolved in anhydrous pyridine (40 mL), followed by stirring with cooling on an ice bath. With cooling the resultant reaction solution, hydroxylamine hydrochloride (4.06 g, 58.7 mmol) was added thereto, followed by stirring for 17 hours and 25 minutes with increasing the temperature up to room temperature. After confirming disappearance of the raw material, the resultant reaction solution was transferred to an eggplant flask with washing with chloroform (containing 1% triethylamine) to be concentrated. The thus obtained residue was added to a saturated sodium bicarbonate solution, and the resultant was stirred for 15 minutes, followed by extraction with chloroform twice. After combining an organic layer, the resultant was washed with a saturated saline solution once, and then was dehydrated with anhydrous sodium sulfate. After filtering the desiccant, the resultant filtrate was concentrated to obtain a compound 14 (4.13 g, mixture with diastereomer, yield for two steps: 81%) in the form of an orange foamy substance.

$^1$H NMR (400 MHz, $CDCl_3$) δ: 12.04 (1H, d, J=23.3 Hz), 9.23 (1H, s), 8.49 (1H, s), 7.89 (1H, s), 7.79 (1H, s), 7.66-7.58 (2H, m), 7.49-7.39 (4H, m), 7.31-7.14 (5H, m), 6.81-6.76 (2H, m), 6.73-6.68 (2H, m), 5.92 (1H, dd, J=8.0, 1.6 Hz), 5.83 (1H, d, J=3.7 Hz), 5.64 (1H, d, J=8.2 Hz), 5.54 (1H, dd, J=3.9, 1.1 Hz), 5.01 (1H, t, J=7.3 Hz), 3.80-3.73 (6H, m), 3.54-3.46 (2H, m), 1.28 (1H, m), 1.08 (1H, d, J=6.9 Hz), 0.99 (1H, d, J=6.9 Hz), 0.86-0.76 (9H, m), 0.47 (2H, m), 0.11 (1H, s), 0.02-0.02 (3H, m), −0.07 (2H, s) [mixture with diastereomer]

ESI-HRMS: calcd for $C_{41}H_{50}N_6O_8Si$, 781.97[M−H]$^-$, found: 781.84[M−H]$^-$.

Step 11 Synthesis of Compound 6 from Compound 14

The compound 14 (3.80 g) obtained in Step 10 was used to obtain the compound 6 (2.12 g, 4.41 mmol, yield: 91%) in the same manner as in Step 3.

It is noted that detailed data of the compound 6 is the same as that described regarding Step 3.

Synthesis of Compound 15

15

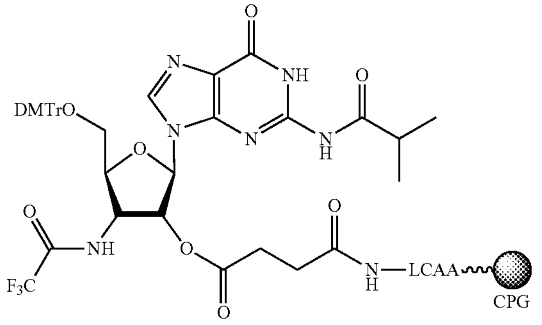

To a solution of the compound 12 (380 mg, 0.50 mmol) in N,N-dimethyliminoformamide (2.5 mL), Native amino lcaa CPG (1000 angstrom, ChemGenes Corp.) (84 μmol/g, 1.20 g, 0.10 mmol) and subsequently a solution of HOBt (136 mg, 1.01 mmol) and EDC-HCl (193 mg, 1.01 mmol) in DMF (2.5 mL) were added, followed by shaking at room temperature. After 20 hours, the resultant reaction solution was discarded, and the solid phase support was washed with N,N-dimethyliminoformamide (5 mL, four times) and subsequently with dichloromethane (5 mL, four times). An unreacted amino group remaining on the solid phase support was capped with a 10% acetic anhydride/pyridine solution (5 mL) (room temperature, shaking for 16 hours). The resultant reaction solution was discarded, and the solid phase support was washed with pyridine (5 mL, once) and subsequently with dichloromethane (5 mL, four times), and then dried under vacuum to obtain a compound 15 (1.20 g) in which the compound 12 is supported on the solid phase support.

An amount of the compound 12 supported on the solid phase was calculated as follows: A prescribed amount of the obtained solid phase support was taken, and color development of 4,4'-dimethoxytrityl cation caused by adding thereto a deblocking reagent (3 w/v % trichloroacetic acid/dichloromethane solution) was measured by ultraviolet visible spectrophotometry (quartz cell, cell length: 10 mm). Based on an absorbance at 504 nm and a molar extinction coefficient of 4,4'-dimethoxytrityl cation (wavelength of 504 mm: 76,000), the amount of the compound 12 supported on the solid phase was calculated by Lambert-Beer method. Specifically, the obtained solid phase support (2.0 mg) was weighed in a 2 mL volumetric flask, the deblocking reagent was added thereto to obtain a total amount of 2 mL, and the resultant was mixed by inverting to obtain a measurement sample. After performing blank measurement using a 3 w/v % trichloroacetic acid/dichloromethane solution, the measurement was performed on the measurement sample. Based on an absorbance at 504 nm of 0.377, the supported amount: 24.8 μmol/g)

Synthesis of a compound 24 was performed in accordance with the following scheme:

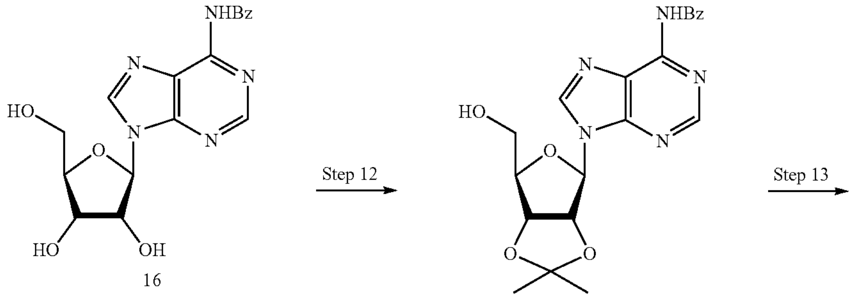

16

17

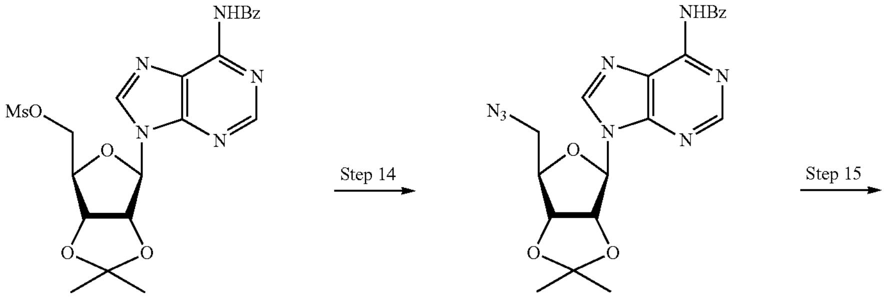

18

19

-continued

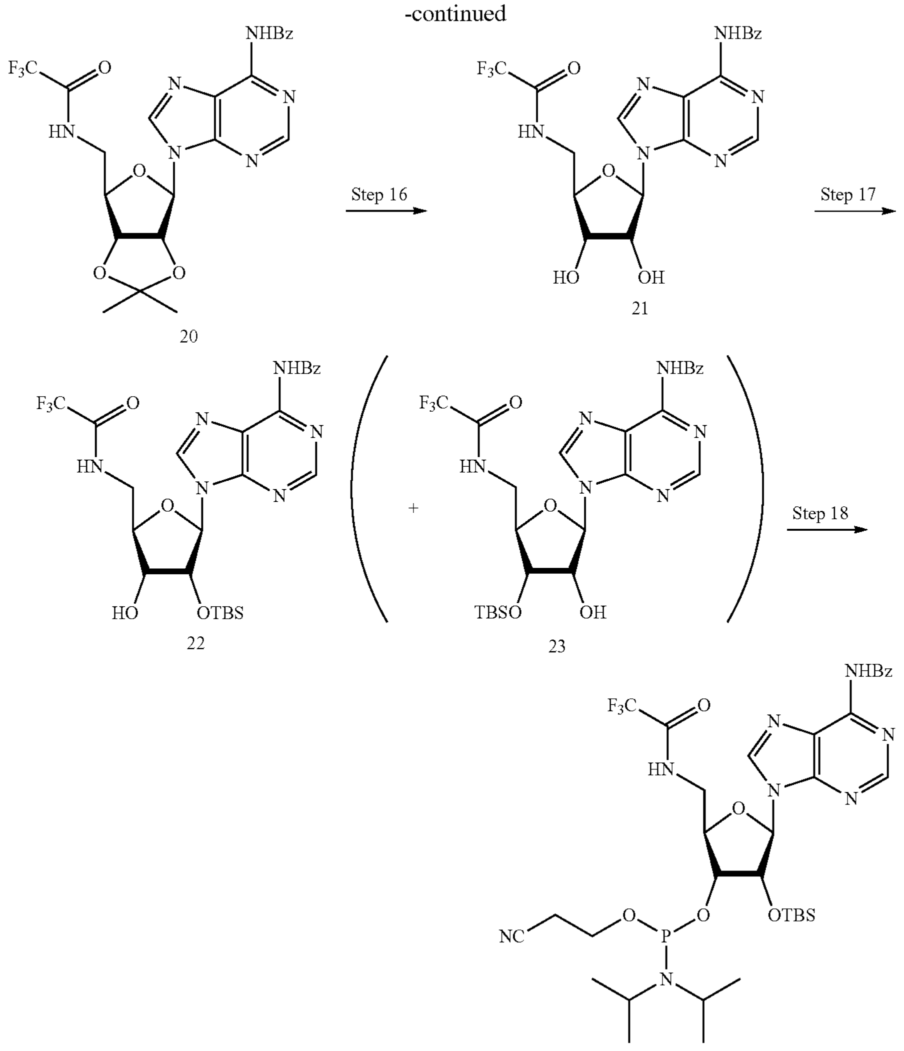

20 21 22 23 24

Step 12 Synthesis of Compound 17

N-(9-((3aR,4R,6R,6aR)-6-(hydroxymethyl)-2,2-dimethyltetrahydrofuro[3,4-d][1,3]dioxol-4-yl)-9H-purin-6-yl)benzamide Under an argon atmosphere, commercially available N6-benzyladenosine (compound 16) (100 g, 269 mmol, 1.0 eq.), acetone (2.70 L), and dimethoxypropane (166 mL, 1.35 mol, 5.0 eq.) were successively added to a 10 L four-neck flask. Concentrated sulfuric acid (1.44 mL, 26.9 mmol, 0.10 eq.) was added to the resultant reaction solution, followed by stirring at room temperature for 15 hours. Since the raw material was found to still remain, concentrated sulfuric acid (1.44 mL, 26.9 mmol, 0.10 eq.) was further added thereto, followed by stirring for 24 hours. Since the raw material was found to still remain, concentrated sulfuric acid (1.44 mL, 26.9 mmol, 0.10 eq.) was further added thereto, followed by stirring for 1 hour and 30 minutes, and then, concentrated sulfuric acid (2.87 mL, 53.8 mmol, 0.20 eq.) was added thereto, followed by stirring for 4 hours.

After checking progress of the reaction by LC/MS, the resultant reaction solution was cooled on an ice bath, and a saturated sodium bicarbonate aqueous solution (400 mL) was added thereto in a dropwise manner over 5 minutes to obtain an internal temperature of 3 to 5° C. to neutralize the resultant solution. The reaction solution was concentrated under reduced pressure, and distilled water (2.0 L) was added to the resultant residue. The resultant solution was extracted with chloroform (1.0 L) three times, and an organic layer was dehydrated with anhydrous sodium sulfate. After filtration, the solvent was distilled off under reduced pressure to obtain a compound 17 (222 g). The thus obtained compound 17 was used in the following step without being subjected to further purification operation.

Step 13 Synthesis of Compound 18

((3aR,4R,6R,6aR)-6-(6-benzamido-9H-purin-9-yl)-2,2-dimethyltetrahydrofuro[3,4-d][1,3]dioxol-4-yl) methyl methanesulfonate Under an argon atmosphere, the compound 17 (222 g) obtained in Step 12 and pyridine (520 mL) were added to a 2 L four-neck flask, the resultant reaction solution was cooled on an ice bath, and methanesulfonyl chloride (25.0 mL, 321 mmol, 1.2 eq.) was added thereto in a dropwise manner over 15 minutes to obtain an internal temperature of 4° C. to 9° C., followed by stirring for 2 hours.

After checking progress of the reaction by LC/MS, distilled water (500 mL) was added to the reaction solution, the resultant solution was extracted with ethyl acetate (1.0 L) three times, and then, an organic layer was washed successively with 1N hydrochloric acid (1.0 L×1,500 mL×2), with a saturated sodium bicarbonate aqueous solution (500 mL×2), and with a saturated saline solution (500 mL×2), and the resultant was dehydrated with anhydrous sodium sulfate. After filtration, the solvent was distilled off under reduced pressure, and the thus obtained residue was azeotroped with toluene to obtain a compound 18 (150 g, containing 17.6 wt % of toluene). The thus obtained compound 18 was used in the following step without being subjected to further purification operation.

Step 14 Synthesis of Compound 19

N-(9-((3aR,4R,6R,6aR)-6-(azidomethyl)-2,2-dimethyltetrahydrofuro[3,4-d][1,3]dioxol-4-yl)-9H-purin-6-yl)benzamide Under an argon atmosphere, the compound 18 (150 g) obtained in Step 13 and dehydrated DMF (1.26 L) were added to a 3 L four-neck flask. To the resultant reaction solution, sodium azide (82.8 g, 1.26 mol, 5.0 eq.) was added, and the temperature was increased up to 60° C. over 30 minutes, followed by stirring for 3 hours and 30 minutes at 60° C.

After checking progress of the reaction by LC/MS, the resultant reaction solution was gradually cooled to room temperature, and distilled water (1.0 L) and ethyl acetate (600 mL) were added thereto. To the thus obtained solution, distilled water (3.0 L) was added, and an aqueous layer was extracted with ethyl acetate (500 mL) six times. An organic layer was washed with distilled water (800 mL) twice and with a saturated saline solution (800 mL) twice, and was dehydrated with anhydrous sodium sulfate. After filtration, the solvent was distilled off under reduced pressure, and the thus obtained residue was purified by silica gel column chromatography ($SiO_2$ 700 g, ethyl acetate) to obtain a compound 19 (55.7 g, 128 mmol, yield: 48% (through three steps from the compound 16)).

Step 15 Synthesis of Compound 20

N-(9-((3aR,4R,6R,6aR)-2,2-dimethyl-6-((2,2,2-trifluoroacetamido)methyl)tetrahydrofuro[3,4-d] [1,3] dioxol-4-yl)-9H-purin-6-yl)benzamide Under an argon atmosphere, the compound 19 (55.7 g, 128 mmol, 1.0 eq.) obtained in Step 14 and methanol (1.28 L) were added to a 3 L four-neck flask. To the resultant reaction solution, 10% Pd/C (76.8 g, 21.2 mmol, 0.17 eq.) was added, and the inside of the reaction solution was replaced with hydrogen, followed by stirring at room temperature for 16 hours.

After checking progress of the reaction by LC/MS, the inside of the resultant reaction solution was replaced with an argon gas, and the reaction solution was subjected to celite filtration. The resultant filtrate was concentrated under reduced pressure, the thus obtained residue was dissolved in methanol (985 mL), and the resultant was transferred to a 3 L four-neck flask. The solution was cooled on an ice bath, and 1-(trifluoroacetyl)imidazole (17.0 mL, 149 mmol, 1.2 eq.) was added thereto in a dropwise manner over 15 minutes to obtain an internal temperature of 2 to 4° C., followed by stirring at 4° C. for 2 hours. After checking progress of the reaction by LC/MS, the reaction solution was concentrated under reduced pressure. The thus obtained residue was purified by silica gel column chromatography ($SiO_2$ 800 g, heptane/ethyl acetate=1:4) to obtain a compound 20 (21.4 g, 42.2 mmol, yield: 33%).

Step 16 Synthesis of Compound 21

N-(9-((2R,3R,4S,5R)-3,4-dihydroxy-5-((2,2,2-trifluoroacetamido)methyl)tetrahydrofuran-2-yl)-9H-purin-6-yl)benzamide To a 1 L eggplant flask, the compound 20 (10.0 g, 19.8 mmol, 10 eq.) obtained in Step 15 and distilled water (50.0 mL) were added, and the resultant solution was cooled on an ice bath. Under ice cooling, trifluoroacetic acid (50.0 mL, 640 mmol, 32.4 eq.) was added thereto in a dropwise manner over 5 minutes, and the temperature of the resultant reaction solution was increased up to room temperature, followed by stirring for 4 hours and 30 minutes.

After checking progress of the reaction by LC/MS, the reaction solution was concentrated under reduced pressure, and the resultant residue was azeotroped with toluene. To the thus obtained residue, isopropyl ether was added to precipitate a solid, which was taken out by filtration. The thus obtained solid was dried under reduced pressure at room temperature to obtain a compound 21 (8.86 g, 19.0 mmol, yield: 96%).

Step 17 Synthesis of Compound 22

N-(9-((2R,3R,4R,5R)-3-((tert-butyldimethylsilyl)oxy)-4-hydroxy-5-((2,2,2-trifluoroacetamido)methyl)tetrahydrofuran-2-yl)-9H-purin-6-yl)benzamide Under an argon atmosphere, the compound 21 (15.6 g, 33.6 mmol, 1.0 eq.) obtained in Step 16 and dehydrated DMF (111 mL) were added to a 500 mL eggplant flask, and the resultant solution was cooled on an ice bath. Under ice cooling, imidazole (9.16 g, 134 mmol, 4.0 eq.) and t-butyldimethylsilyl chloride (15.2 g, 101 mmol, 3.0 eq.) were added thereto to obtain an internal temperature less than 6° C., followed by stirring for 30 minutes at the same temperature.

After checking progress of the reaction by LC/MS, ice water was added to the resultant reaction solution. An aqueous layer was extracted with ethyl acetate three times, washed with a saturated saline solution, and dehydrated with anhydrous sodium sulfate. After filtration, the solvent was distilled off under reduced pressure, and the thus obtained residue was purified by silica gel column chromatography ($SiO_2$ 800 g, chloroform/2-butanone=100:0 to 85:15) to obtain a mixture (10.9 g) of a compound 22 and a compound 23. The thus obtained mixture of the compound 22 and the compound 23 was used in the following step without being subjected to further purification operation.

Step 18 Synthesis of Compound 24

(2R,3R,4R,5R)-5-(6-benzamido-9H-purin-9-yl)-4-((tert-butyldimethylsilyl)oxy)-2-((2,2,2-trifluoroacetamido)methyl)tetrahydrofuran-3-yl(2-cyanoethyl) diisopropylphosphoramidite Under an argon atmosphere, the mixture of the compound 22 and the compound 23 (1.19 g, 2.05 mmol, Compound 22:Compound 23=9:1) obtained in Step 17 and dehydrated dichloromethane (6.83 mL) were added to a 200 mL egg-plant flask, and the resultant solution was cooled on an ice bath. Under ice cooling, a mixed solution of diisopropylethylamine (0.537 mL, 3.07 mmol, 1.5 eq.) and 3-((chloro (diisopropylamino)phosphanyl)oxy)propanenitrile (0.857 mL, 3.07 mmol, 1.5 eq.) in dichloromethane was added thereto in a dropwise manner, and the temperature of the resultant reaction solution was increased up to room temperature, followed by stirring at room temperature for 2 hours.

After confirming disappearance of the raw material by TLC, distilled water was added to the resultant reaction solution, the resultant was extracted with chloroform (50 mL) twice, and an organic layer was dehydrated with anhydrous sodium sulfate. After filtration, the solvent was distilled off under reduced pressure, and the thus obtained residue was purified several times by silica gel column chromatography (heptane/ethyl acetate=50:50 to 30:70, containing 0.5% triethylamine) to obtain a target compound 24 (608 mg, 0.779 mmol, yield: 38%) in the form of a pale yellow amorphous substance.

$^1$H NMR (400 MHz, $CDCl_3$) δ: 9.82 (1H, d, J=8.8 Hz), 9.07 (1H, s), 8.83-8.80 (1H, m), 8.06-8.01 (3H, m), 7.66-7.52 (3H, m), 5.86 (1H, d, J=7.8 Hz), 4.88 (1H, dd, J=7.8, 5.2 Hz), 4.50 (1H, br s), 4.39-4.29 (1H, m), 4.21-3.88 (3H, m), 3.74-3.63 (1H, m), 3.48-3.35 (1H, m), 2.73-2.66 (2H, m), 1.28-1.23 (12H, m), 1.08-1.04 (1H, m), 0.72-0.68 (9H, m), −0.17 (3H, s), −0.45 (3H, s).

$^{31}$P NMR(CDC13) δ: 149.95

Synthesis of a compound 6a to be used as a raw material of the polynucleotide was performed in accordance with the following scheme:

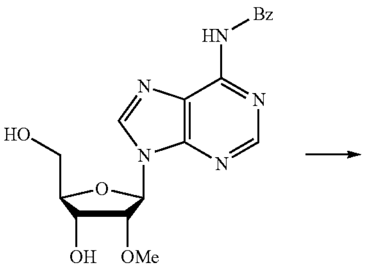

1a

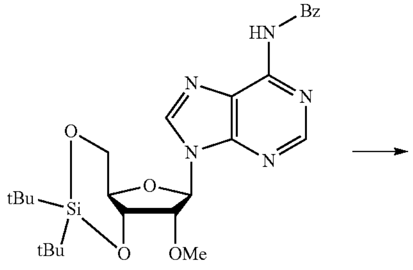

2a

-continued

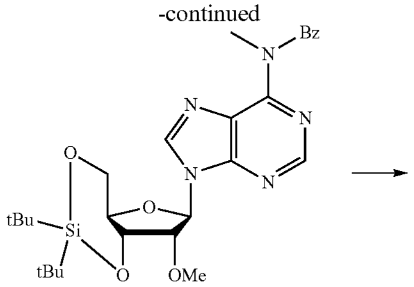

3a

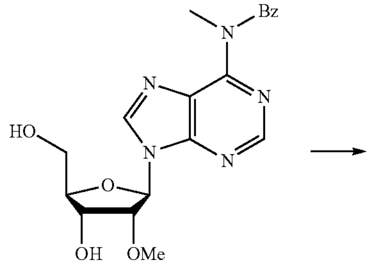

4a

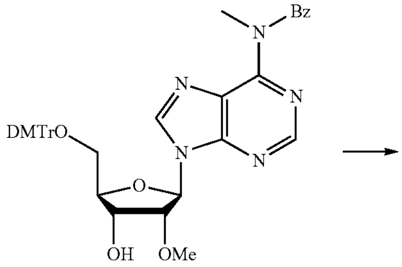

5a

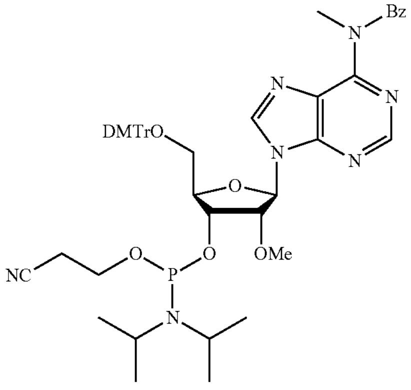

6a

Step 1 Synthesis of Compound 2a

N-(9-((3aR,5R,6R,6aS)-2,2-di-tert-butyl methoxytetrahydrofuro[2,3-d][1,3,2]dioxasilol-5-yl)-9H-purin-6-yl)benzamide To a solution of a commercially available compound 1a (30.0 g, 78.0 mmol) in DMF (300 mL), di-t-butylsilylbis (trifluoromethanesulfonate) (68.6 g, 156 mmol) was slowly added under ice cooling. After stirring the resultant for 1 hour under ice cooling, the resultant reaction solution was added to a saturated sodium bicarbonate aqueous solution, and a mixed solvent of heptane/ethyl acetate was added thereto for performing extraction twice. An organic layer was washed with water twice, and with a saturated saline solution once, and was dried over anhydrous sodium sulfate. After filtration, the resultant concentrated residue was purified by silica gel column chromatography (heptane/ethyl acetate=7/3 to 3/7) to obtain a compound 2a (38.7 g, 73.7 mmol) in the form of a colorless solid (yield: 95%).

ESI-MS: calcd: 524.23 $[M-H]^-$, found: 524.5 $[M-H]^-$.

$^1$H-NMR ($CDCl_3$, 400 MHz) δ: 9.32 (s, 1H), 8.76 (s, 1H), 8.05 (s, 1H), 8.03 (t, J=6.6 Hz, 2H), 7.60 (t, J=7.3 Hz, 1H), 7.51 (t, J=7.8 Hz, 2H), 6.01 (s, 1H), 4.66 (dd, J=9.6, 5.0 Hz, 1H), 4.48 (dd, J=8.9, 4.8 Hz, 1H), 4.31 (d, J=4.6 Hz, 1H), 4.20 (ddd, J=10.1, 5.0, 5.0 Hz, 1H), 4.03 (t, J=9.8 Hz, 1H), 3.70 (s, 3H), 1.10 (s, 9H), 1.06 (s, 9H).

Step 2 Synthesis of Compound 3a

N-(9-((3aR,5R,6R,6aS)-2,2-di-tert-butyl-6-methoxytetrahydrofuro[2,3-d][1,3,2]dioxasilol-5-yl)-9H-purin-6-yl)-N-methylbenzamide The compound 2a (10.0 g, 19.0 mmol) was dissolved in dichloromethane (50 mL), and tetrabutylammonium bromide (9.20 g, 28.5 mmol) and a 1 M sodium hydroxide aqueous solution (50 ml) were added to the resultant. Methyl iodide (4.76 ml, 76.0 mmol) was slowly added thereto in a dropwise manner. Thereafter, the resultant was stirred at room temperature for 1 hour and 10 minutes. After confirming disappearance of the raw material, the resultant reaction solution was added to ice cooled water/chloroform=1/1 for quenching. An organic layer was washed with water twice, and was dehydrated with anhydrous sodium sulfate, the desiccant was filtered out, and the resultant filtrate was concentrated. The thus obtained concentrated residue was purified by silica gel column chromatography (heptane/ethyl acetate=90/10 to 50/50) to obtain a compound 3a (6.25 g, 11.6 mmol) in the form of a colorless amorphous (yield: 61%).

ESI-MS: calcd: 540.26 $[M+H]^+$, found: 540.4 $[M+H]^+$.

$^1$H-NMR ($CDCl_3$, 400 MHz) δ: 8.56 (s, 1H), 7.94 (s, 1H), 7.49-7.46 (m, 2H), 7.34-7.29 (m, 1H), 7.21 (t, J=7.6 Hz, 2H), 5.94 (s, 1H), 4.61 (dd, J=9.6, 5.0 Hz, 1H), 4.46 (dd, J=9.2, 5.0 Hz, 1H), 4.22 (d, J=4.6 Hz, 1H), 4.17 (ddd, J=10.0, 5.2, 5.0 Hz, 1H), 4.00 (dd, J=10.5, 9.2 Hz, 1H), 3.79 (s, 3H), 3.67 (s, 3H), 1.08 (s, 9H), 1.05 (s, 9H).

Step 3 Synthesis of Compound 4a

N-(9-((2R,3R,4S,5S)-4,5-dihydroxy-3-methoxytetrahydrofuran-2-yl)-9H-purin-6-yl)-N-methylbenzamide The compound 3a (6.25 g, 11.6 mmol) was dissolved in tetrahydrofuran (63 mL), and the resultant was cooled on an ice bath. Triethylamine (8.07 ml, 57.9 mmol) and triethylamine trihydrofluoride (1.89 ml, 11.6 mmol) were added thereto, followed by stirring for 1 hour and 5 minutes with cooling on an ice bath. After confirming disappearance of the raw material, triethylamine (10 ml, 76.0 mmol) was added thereto for quenching, the resultant was diluted with chloroform, and the resultant reaction solution was concentrated. The thus obtained concentrated residue was purified by silica gel column chromatography (chloroform/methanol=100/0 to 90/10) to obtain a compound 4a (4.25 g, 10.6 mmol) in the form of a colorless amorphous (yield: quant.).

ESI-MS: calcd: 400.16 $[M+H]^+$, found: 400.3 $[M+H]^+$.

$^1$H-NMR ($CDCl_3$, 400 MHz) δ: 8.56 (s, 1H), 7.97 (s, 1H), 7.50-7.48 (m, 2H), 7.35-7.31 (m, 1H), 7.22 (t, J=7.8 Hz, 2H), 5.87 (d, J=7.3 Hz, 1H), 5.86 (dd, J=11.4, 2.3 Hz, 1H), 4.63 (dd, J=7.3, 4.6 Hz, 1H), 4.57-4.56 (m, 1H), 4.36-4.34 (m, 1H), 3.99-3.94 (m, 1H), 3.81 (s, 3H), 3.77 (td, J=12.3, 1.7 Hz, 1H), 3.31 (s, 3H), 2.77 (d, J=1.4 Hz, 1H).

Step 4 Synthesis of Compound 5a

N-(9-((2R,3R,4S,5S)-5-(bis(4-methoxyphenyl)(phenyl)methoxy)-4-hydroxy-3-methoxytetrahydrofuran-2-yl)-9H-purin-6-yl)-N-methylbenzamide The compound 4a (4.25 g, 10.6 mmol) was dissolved in pyridine (43 mL), and the resultant was stirred on an ice bath. To the resultant reaction solution, 4,4'-dimethoxytrityl chloride (5.41 g, 20.0 mmol) was added, followed by stirring at room temperature for 2 hours and 25 minutes. After confirming disappearance of the raw material, the resultant reaction solution was added to ice cooled sodium bicarbonate water for quenching, and the resultant was extracted with ethyl acetate. An organic layer was washed with a saturated saline solution, dried over anhydrous sodium sulfate, and was filtered, and then, the thus obtained filtrate was concentrated. The thus obtained concentrated residue was purified by silica gel column chromatography (heptane/ethyl acetate (containing 1% triethylamine)=70/30 to 50/50) to obtain a compound 5a (5.35 g, 7.62 mmol) in the form of a colorless amorphous. (yield 71%)

ESI-MS: calcd: 702.29 $[M+H]^+$, found: 702.6 $[M+H]^+$.

$^1$H-NMR ($CDCl_3$, 400 MHz) δ: 8.50 (s, 1H), 8.14 (s, 1H), 7.45-7.40 (m, 4H), 7.33-7.22 (m, 8H), 7.16 (t, J=7.6 Hz, 2H), 6.81 (dd, J=8.9, 1.1 Hz, 4H), 6.15 (d, J=3.7 Hz, 1H), 4.48 (dd, J=11.9, 5.0 Hz, 1H), 4.35 (dd, J=5.3, 3.9 Hz, 1H), 4.21-4.19 (m, 1H), 3.80 (s, 3H), 3.79 (s, 6H), 3.53 (s, 3H), 3.50 (dd, J=10.8, 3.0 Hz, 1H), 3.40 (dd, J=10.8, 4.4 Hz, 1H), 2.66 (d, J=6.4 Hz, 1H).

Step 5 Synthesis of Amidite 6a (2S,3S,4R,5R)-2-(bis(4-methoxyphenyl)(phenyl)methoxy)-4-methoxy-5-(6-(N-methylbenzamido)-9H-purin-9-yl)tetrahydrofuran-3-yl(2-cyanoethyl) diisopropylphosphoramidite The compound 5a (5.30 g, 7.55 mmol) was dissolved in dichloromethane (48 mL), diisopropylethylamine (2.64 mL, 15.1 mmol) was added thereto, and the resultant was cooled on an ice bath. To the resultant, 2-cyanoethyl diisopropylchlorophosphoramidite (2.68 g, 11.3 mmol) dissolved in dichloromethane (5 mL) was added thereto in a dropwise manner over 5 minutes. Thereafter, the resultant was stirred for 1 hour and 10 minutes with increasing the temperature up to room temperature. After confirming disappearance of the raw material, the resultant reaction solution was added to ice cooled saturated sodium bicarbonate water for quenching. Ethyl acetate was added to the resultant for extraction. An organic layer was washed with a saturated saline solution, and was dried over anhydrous sodium sulfate, the desiccant was removed by filtration, and the thus obtained filtrate was concentrated. The thus obtained concentrated residue was purified by silica gel column chromatography (heptane/ethyl acetate (containing 1% triethylamine)=70/30 to 50/50) to obtain an amidite 6a (6.22 g, 6.90 mmol) in the form of a colorless amorphous. (yield: 91%)

ESI-MS: calcd: 902.40 $[M+H]^+$, found: 902.5 $[M+H]^+$.

$^1$H-NMR ($CDCl_3$, 400 MHz) δ: 8.47 (s, 0.35H), 8.47 (s, 0.65H), 8.14 (s, 0.35H), 8.09 (s, 0.65H), 7.44-7.39 (m, 4H), 7.33-7.21 (m, 8H), 7.16-7.12 (m, 2H), 6.93-6.78 (m, 4H), 6.12 (d, J=5.5, 0.65H), 6.10 (d, J=5.0, 0.35H), 4.66-4.53 (m, 2H), 4.41-4.38 (m, 0.35H), 4.34-4.32 (m, 0.65H), 3.97-3.78 (m, 10H), 3.70-3.44 (m, 7H), 3.36-3.30 (m, 1H), 2.64 (t, J=6.2 Hz, 1.3H), 2.38 (t, J=6.4 Hz, 0.70H), 1.22-1.17 (m, 8H), 1.06 (d, J=6.9 Hz, 4H).

$^{31}$P-NMR($CDCl_3$, 162 MHz) δ: 150.70, 150.94.

Synthesis of a compound 6b to be used as a raw material of the polynucleotide was performed in accordance with the following scheme:

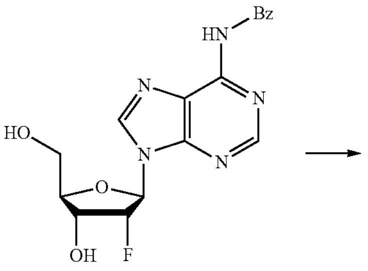

1b

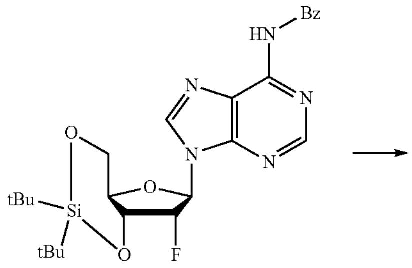

2b

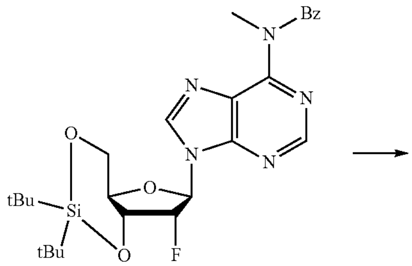

3b

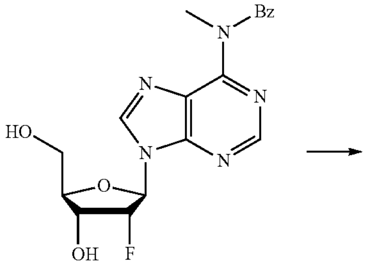

4b

-continued

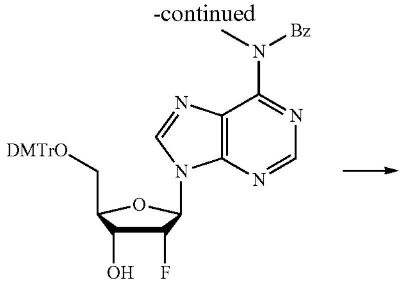

5b

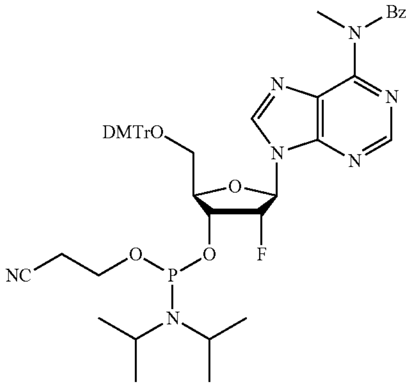

6b

Step 1 Synthesis of Compound 2b

N-(9-((4aR,6R,7R,7aS)-2,2-di-tert-butyl-7-fluorotetrahydro-4H-furo[3,2-d][1,3,2]dioxasilin-6-yl)-9H-purin-6-yl)benzamide To a solution of a commercially available compound 1b (30.0 g, 80.4 mmol) in DMF (300 mL), di-t-butylsilylbis (trifluoromethanesulfonate) (70.8 g, 161 mmol) was slowly added under ice cooling. After stirring the resultant for 1 hour under ice cooling, the resultant reaction solution was added to a saturated sodium bicarbonate aqueous solution, a mixed solvent of heptane/ethyl acetate was added thereto, and the resultant was extracted twice. An organic layer was washed with water twice, and with a saturated saline solution once, and was dried over anhydrous sodium sulfate. After filtration, the thus obtained concentrated residue was subjected to slurry purification with heptane/ethyl acetate=9/1 to obtain a compound 2b (38.7 g, 75.4 mmol) in the form of a colorless solid (yield: 94%).

ESI-MS: calcd: 514.23 $[M+H]^+$, found: 514.5 $[M+H]^+$.

$^1$H-NMR (DMSO-$d_5$, 400 MHz) δ: 11.27 (s, 1H), 8.74 (s, 1H), 8.65 (s, 1H), 8.04 (d, J=8.7 Hz, 2H), 7.65 (t, J=7.5 Hz, 1H), 7.55 (t, J=7.5 Hz, 2H), 6.45 (d, J=23 Hz, 1H), 5.71 (dd, J=54.5, 4.1 Hz, 1H), 5.03 (m, 1H), 4.44 (q, J=3.7 Hz, 1H), 4.09 (m, 2H), 1.11 (s, 9H), 1.02 (s, 9H).

Step 2 Synthesis of Compound 3b

N-(9-((4aR,6R,7R,7aS)-2,2-di-tert-butyl-7-fluorotetrahydro-4H-furo[3,2-d][1,3,2]dioxasilin-6-yl)-9H-purin-6-yl)-N-methylbenzamide The compound 2b (10.0 g, 19.5 mmol) was dissolved in dichloromethane (50 mL), and tetrabutylammonium bromide (9.41 g, 29.2 mmol) and a 1 M sodium hydroxide aqueous solution (50 ml) were added to the resultant. Methyl iodide (1.83 ml, 29.2 mmol) was slowly added thereto in a dropwise manner. Thereafter, the resultant was stirred at room temperature for 1 hour. After confirming disappearance of the raw material, the resultant reaction solution was added to ice cooled water/chloroform=1/1 for quenching. An organic layer was washed with water twice, and was dehydrated with anhydrous sodium sulfate, the desiccant was filtered out, and the thus obtained filtrate was concentrated. The thus obtained concentrated residue was purified by silica gel column chromatography (heptane/ethyl acetate=90/10 to 50/50) to obtain a compound 3b (6.86 g, 12.8 mmol) in the form of a colorless amorphous. (yield: 65%)

ESI-MS: calcd: 528.24 $[M+H]^+$, found: 538.6 $[M+H]^+$.

$^1$H-NMR ($CDCl_3$, 400 MHz) δ: 8.54 (s, 1H), 7.94 (s, 1H), 7.47 (d, J=8.1 Hz, 2H), 7.32 (t, J=7.3 Hz, 2H), 7.21 (t, J=7.6 Hz, 2H), 6.10 (d, J=22.0 Hz, 1H), 5.46 (dd, J=54.5, 4.1 Hz, 1H), 4.86 (ddd, J=27.2, 9.8, 4.1 Hz, 1H), 4.47 (dd, J=9.2, 5.0 Hz, 1H), 4.14 (m, 1H), 4.03 (t, J=9.8 Hz, 1H), 3.78 (s, 3H), 1.11 (s, 9H), 1.05 (s, 9H).

Step 3 Synthesis of Compound 4b

N-(9-((2R,3R,4R,5R)-3-fluoro-4-hydroxy-5-(hydroxymethyl)tetrahydrofuran-2-yl)-9H-purin-6-yl)-N-methylbenzamide The compound 3b (6.67 g, 12.6 mmol) was dissolved in tetrahydrofuran (66 mL), and the resultant was cooled on an ice bath. To the resultant, triethylamine (8.81 ml, 63.2 mmol) and triethylamine trihydrofluoride (2.05 ml, 12.6 mmol) were added, followed by stirring for 1 hour and 5 minutes with cooling the resultant on an ice bath. After confirming disappearance of the raw material, triethylamine (10.6 ml, 76.0 mmol) was added to the resultant for quenching, the resultant was diluted with chloroform, and then, the resultant reaction solution was concentrated. The thus obtained concentrated residue was purified by silica gel column chromatography (chloroform/methanol=100/0 to 90/10) to obtain a compound 4b (4.98 g, 12.9 mmol) in the form of a colorless amorphous. (yield: quant.)

ESI-MS: calcd: 388.14 $[M+H]^+$, found: 388.4 $[M+H]^+$.

$^1$H-NMR (DMSO-$d_5$, 400 MHz) δ: 8.70 (s, 1H), 8.58 (s, 1H), 7.30 (m, 5H), 6.31 (dd, J=16.9, 2.3 Hz, 1H), 5.75 (d, J=6.4 Hz, 1H), 5.41 (m, 1H), 5.15 (t, J=5.3 Hz, 1H), 4.46 (m, 1H), 3.98 (m, 1H), 3.75 (dq, J=12.4, 2.6 Hz, 1H), 3.67 (s, 3H), 3.61-3.56 (m, 1H).

Step 4 Synthesis of Compound 5b

N-(9-((2R,3R,4R,5R)-5-((bis(4-methoxyphenyl)(phenyl)methoxy)methyl)-3-fluoro hydroxytetrahydrofuran-2-yl)-9H-purin-6-yl)-N-methylbenzamide The compound 4b (4.93 g, 12.7 mmol) was dissolved in pyridine (49 mL), and the resultant was stirred on an ice bath. To the resultant reaction solution, 4,4'-dimethoxytrityl chloride (6.47 g, 29.2 mmol) was added, followed by stirring at room temperature for 1 hour and 20 minutes. After confirming disappearance of the raw material, the resultant reaction solution was added to ice cooled sodium bicarbonate water for quenching, followed by extraction with ethyl acetate. An organic layer was washed with a saturated saline solution, was dried over anhydrous sodium sulfate, and was filtered, and the thus obtained filtrate was concentrated. The thus obtained concentrated residue was purified by silica gel column chromatography (heptane/ethyl acetate (containing 1% triethylamine)=70/30 to 50/50) to obtain a compound 5b (8.34 g, 12.1 mmol) in the form of a colorless amorphous. (yield: 95%)

ESI-MS: calcd: 690.27 $[M+H]^+$, found: 690.7 $[M+H]^+$.

$^1$H-NMR ($CDCl_3$, 400 MHz) δ: 8.51 (s, 1H), 8.10 (s, 1H), 7.43 (dd, J=8.2, 1.4 Hz, 2H), 7.37 (dd, 8.2, 1.4 Hz, 2H), 7.28-7.20 (m, 8H), 7.12 (t, J=7.5 Hz, 2H), 6.79 (d, J=8.7 Hz), 6.23 (dd, J=17.1, 2.5 Hz, 1H), 5.58 (dq, J=52.9, 2.3 Hz, 1H), 4.78 (m, 1H), 4.19 (m, 1H), 3.78 (s, 6H), 3.47 (ddd, J=57.9, 10.6, 3.5 Hz, 2H), 2.44 (dd, J=7.5, 2.5 Hz, 1H).

Step 5 Synthesis of Amidite 6b (2R,3R,4R,5R)-2-((bis(4-methoxyphenyl)(phenyl)methoxy)methyl)-4-fluoro-5-(6-(N-methylbenzamido)-9H-purin-9-yl)tetrahydrofuran-3-yl(2-cyanoethyl)diisopropylphosphoramidite The compound 5b (10.0 g, 14.6 mmol) was dissolved in dichloromethane (80 mL), diisopropylethylamine (5.08 mL, 29.1 mmol) was added thereto, and the resultant was cooled on an ice bath. To the resultant, 2-cyanoethyl diisopropylchlorophosphoramidite (4.18 g, 21.8 mmol) dissolved in dichloromethane (15 mL) was added in a dropwise manner over 5 minutes. Thereafter, the resultant was stirred for 1 hour with increasing the temperature up to room temperature. After confirming disappearance of the raw material, the resultant reaction solution was added to ice cooled sodium bicarbonate water for quenching. To the resultant, ethyl acetate was added for extraction. An organic layer was washed with a saturated saline solution, and was dried over anhydrous sodium sulfate, the desiccant was filtered out, and the resultant filtrate was concentrated. The thus obtained concentrated residue was purified by silica gel column chromatography (heptane/ethyl acetate (containing 1% triethylamine)=70/30 to 50/50) to obtain an amidite 6b (12.1 g, 13.6 mmol) in the form of a colorless amorphous. (yield: 93%)

ESI-MS: calcd: 890.38 $[M+H]^+$, found: 890.8 $[M+H]^+$.

$^1$H-NMR ($CDCl_3$, 400 MHz) δ: 8.53 (s, 0.49H), 8.50 (s, 0.51H), 8.14 (s, 1H), 7.43-7.39 (m, 2H), 7.37-7.33 (m, 2H), 7.27-7.20 (m, 8H), 7.09-7.04 (m, 2H), 6.77 (t, J=9.1 Hz, 4H), 6.28-6.19 (m, 1H), 5.74 (dq, J=18.5, 2.2 Hz, 0.50H), 5.61 (dq, J=19.2, 2.3 Hz, 0.50H), 5.10-5.00 (m, 0.47H), 4.94-4.85 (m, 0.53H), 4.31 (m, 1H), 3.97-3.82 (m, 1H), 3.79 (s, 3H), 3.79 (s, 3H), 3.63-3.53 (m, 4H), 3.31-3.27 (m, 1H), 2.59 (t, J=6.2 Hz, 1H), 2.41 (t, J=6.4 Hz, 1H), 1.20-1.15 (m, 9H), 1.04 (d, J=6.4 Hz, 3H).

$^{31}$P-NMR($CDCl_3$, 162 MHz) δ: 151.97, 151.92, 151.19, 151.11.

Synthesis of a compound 6c to be used as a raw material of the polynucleotide was performed in accordance with the following scheme:

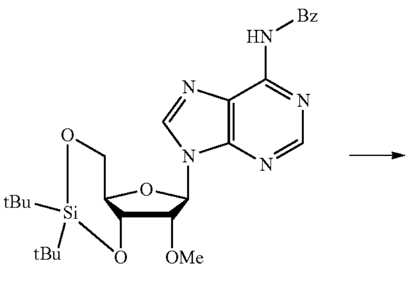

2a

-continued

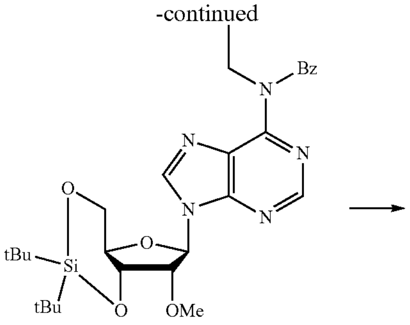

3c

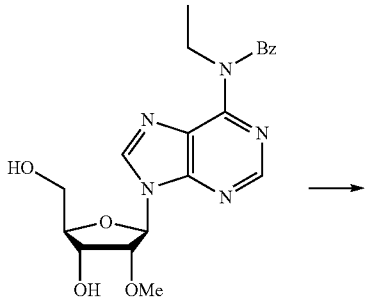

4c

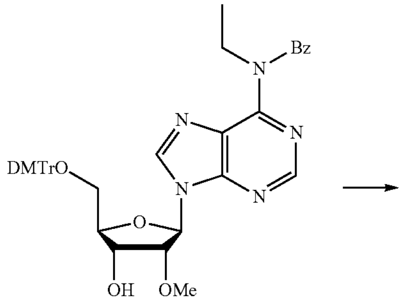

5c

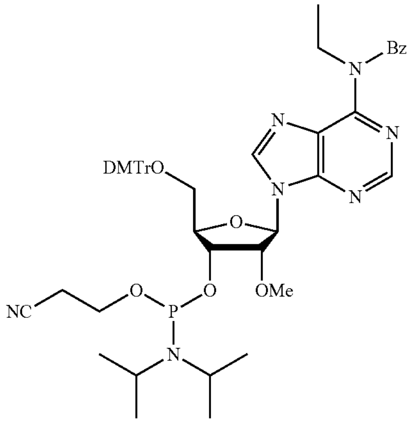

6c

Step 1 Synthesis of Compound 3c

N-(9-((4aR,6R,7R,7aS)-2,2-di-tert-butyl-7-methoxytetrahydro-4H-furo[3,2-d][1,3,2]dioxasilin-6-yl)-9H-purin-6-yl)-N-ethylbenzamide The compound 2a (11.7 g, 22.3 mmol) was dissolved in dichloromethane (58.5 mL), and tetrabutylammonium bromide (10.8 g, 33.4 mmol) and a 1 M sodium hydroxide aqueous solution (58.5 ml) were added thereto. Ethyl iodide (10.8 ml, 134 mmol) was slowly added to the resultant in a dropwise manner. Thereafter, the resultant was stirred at room temperature for 2 hours. After confirming disappearance of the raw material, the resultant reaction solution was added to ice cooled water/chloroform=1/1 for quenching. An organic layer was washed with water twice, and was dried over anhydrous sodium sulfate. After filtration, the resultant filtrate was concentrated. The thus obtained concentrated residue was subjected to slurry purification with toluene, and the resultant filtrate was concentrated again. The resultant concentrated residue was purified by silica gel column chromatography (heptane/ethyl acetate=90/10 to 70/30) to obtain a compound 3c (6.14 g, 11.1 mmol) in the form of a colorless amorphous. (yield: 49%)

ESI-MS: calcd: 554.28 $[M+H]^+$, found: 554.6 $[M+H]^+$.

$^1$H-NMR ($CDCl_3$, 400 MHz) δ: 8.56 (s, 1H), 7.91 (s, 1H), 7.47-7.45 (m, 2H), 7.31-7.27 (m, 1H), 7.19 (t, J=7.5 Hz, 2H), 5.94 (s, 1H), 4.61 (dd, J=9.6, 4.6 Hz, 1H), 4.46 (dd, J=9.1, 5.0 Hz, 1H), 4.40 (q, J=7.0 Hz, 2H), 4.22 (d, J=4.6 Hz, 1H), 4.16 (ddd, J=10.1, 4.9, 4.8 Hz, 1H), 4.00 (dd, J=10.5, 9.6 Hz, 1H), 3.67 (s, 3H), 1.34 (t, J=7.1 Hz, 3H), 1.09 (s, 9H), 1.05 (s, 9H).

Step 2 Synthesis of Compound 4c

N-ethyl-N-(9-((2R,3R,4R,5R)-4-hydroxy-5-(hydroxymethyl)-3-methoxytetrahydrofuran-2-yl)-9H-purin-6-yl)benzamide The compound 3c (6.14 g, 11.1 mmol) was dissolved in tetrahydrofuran (61.4 mL), followed by cooling on an ice bath. Triethylamine (7.73 ml, 55.4 mmol) and triethylamine trihydrofluoride (1.81 ml, 11.1 mmol) were added to the resultant, followed by stirring for 2 hours with cooling on an ice bath. After confirming disappearance of the raw material, triethylamine (10 ml, 76.0 mmol) was added to the resultant for quenching, the resultant was diluted with chloroform, and the resultant reaction solution was concentrated. The thus obtained concentrated residue was purified by silica gel column chromatography (chloroform/methanol=100/0 to 90/10) to obtain a compound 4c (4.60 g, 11.1 mmol) in the form of a colorless amorphous. (yield: quant.)

ESI-MS: calcd: 414.18 $[M+H]^+$, found: 414.3 $[M+H]^+$.

$^1$H-NMR ($CDCl_3$, 400 MHz) δ: 8.56 (s, 1H), 7.92 (s, 1H), 7.50-7.46 (m, 2H), 7.32-7.28 (m, 1H), 7.20 (t, J=7.5 Hz, 2H), 5.89 (dd, J=11.6, 2.1 Hz, 1H), 5.85 (d, J=7.3 Hz, 1H), 4.62 (dd, J=7.3, 4.6 Hz, 1H), 4.57-4.56 (m, 1H), 4.45-4.39 (m, 2H), 4.36-4.34 (m, 1H), 3.96 (dt, J=12.9, 1.9, 1H), 3.80-3.73 (m, 1H), 3.29 (s, 3H), 2.70 (d, J=1.4 Hz, 1H), 1.37 (t, J=7.1 Hz, 3H).

Step 3 Synthesis of Compound 5c

N-(9-((2R,3R,4R,5R)-5-((bis(4-methoxyphenyl)(phenyl)methoxy)methyl)-4-hydroxy-3-methoxytetrahydrofuran-2-yl)-9H-purin-6-yl)-N-ethylbenzamide The compound 4c (4.58 g, 11.1 mmol) was dissolved in pyridine (46 mL), followed by stirring on an ice bath. To the resultant reaction solution, 4,4'-dimethoxytrityl chloride (5.63 g, 16.6 mmol) was added, followed by stirring at room temperature for 2 hours. After confirming disappearance of the raw material, the resultant reaction solution was added to ice cooled sodium bicarbonate water for quenching, and the resultant was extracted with ethyl acetate. An organic layer was washed with a saturated saline solution, and was dried over anhydrous sodium sulfate. After filtration, the resultant filtrate was concentrated. The thus obtained concentrated residue was purified by silica gel column chromatography (heptane/ethyl acetate (containing 1% triethylamine)=70/30 to 50/50) to obtain a compound 5c (7.55 g, 10.6 mmol) in the form of a colorless amorphous. (yield: 95%)

ESI-MS: calcd: 716.31 $[M+H]^+$, found: 716.2 $[M+H]^+$.

$^1H$-NMR ($CDCl_3$, 400 MHz) δ: 8.51 (s, 1H), 8.11 (s, 1H), 7.43-7.40 (m, 4H), 7.32-7.22 (m, 8H), 7.13 (t, J=7.5 Hz, 2H), 6.81 (dd, J=9.1, 1.4 Hz, 4H), 6.14 (d, J=3.7 Hz, 1H), 4.47 (dd, J=5.7, 5.6 Hz, 1H), 4.41 (q, J=7.0 Hz, 2H), 4.34 (dd, J=8.4, 4.1 Hz, 1H), 4.21-4.17 (m, 1H), 3.79 (s, 6H), 3.53 (s, 3H), 3.50 (dd, J=10.5, 3.2 Hz, 1H), 3.39 (dd, J=10.7, 4.3 Hz, 1H), 2.64 (d, J=6.4 Hz, 1H), 1.34 (t, J=7.1 Hz, 3H).

Step 4 Synthesis of Amidite 6c (2R,3R,4R,5R)-2-((bis(4-methoxyphenyl)(phenyl)methoxy)methyl)-5-(6-(N-ethylbenzamido)-9H-purin-9-yl)-4-methoxytetrahydrofuran-3-yl(2-cyanoethyl)diisopropylphosphoramidite The compound 5c (8.83 g, 12.3 mmol) was dissolved in dichloromethane (74 mL), and diisopropylethylamine (4.31 mL, 24.7 mmol) was added to the resultant, followed by cooling on an ice bath. To the resultant, 2-cyanoethyldiisopropylchlorophosphoramidite (4.40 g, 18.6 mmol) dissolved in dehydrated dichloromethane (14 mL) was added in a dropwise manner over 9 minutes. Thereafter, the resultant was stirred for 1 hour with increasing the temperature up to room temperature. After confirming disappearance of the raw material, the resultant reaction solution was added to ice cooled saturated sodium bicarbonate water for quenching. Ethyl acetate was added to the resultant for extraction. An organic layer was washed with a saturated saline solution, and was dried over anhydrous sodium sulfate. After filtration, the resultant filtrate was concentrated. The thus obtained concentrated residue was purified by silica gel column chromatography (heptane/ethyl acetate (containing 1% triethylamine)=70/30 to 50/50) to obtain an amidite 6c (10.4 g, 11.3 mmol) in the form of a colorless amorphous. (yield: 92%)

ESI-MS: calcd: 916.42 $[M+H]^+$, found: 917.3 $[M+H]^+$.

$^1H$-NMR ($CDCl_3$, 400 MHz) δ: 8.49 (s, 0.37H), 8.48 (s, 0.63H), 8.11 (s, 0.34H), 8.05 (s, 0.66H), 7.43-7.38 (m, 4H), 7.32-7.21 (m, 8H), 7.11 (t, J=7.8 Hz, 2H), 6.80 (m, 4H), 6.10 (m, 1H), 4.64-4.52 (m, 2H), 4.43-4.32 (m, 3H), 3.94-3.83 (m, 1H), 3.79-3.78 (m, 6H), 3.67-3.46 (m, 4H), 3.35-3.29 (m, 1H), 2.64 (t, J=6.4 Hz, 1.3H), 2.37 (t, J=6.4 Hz, 0.70H), 1.33 (t, J=7.1 Hz, 3H), 1.18 (m, 8H), 1.06 (d, J=6.9 Hz, 4H).

$^{31}P$-NMR($CDCl_3$, 162 MHz) δ: 151.67, 150.92.

Synthesis of a compound 6d to be used as a raw material of the polynucleotide was performed in accordance with the following scheme:

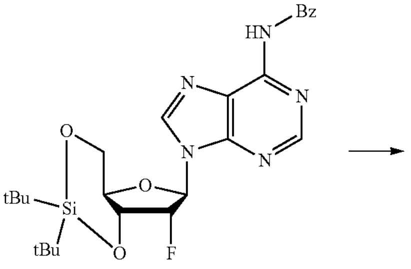

2b

-continued

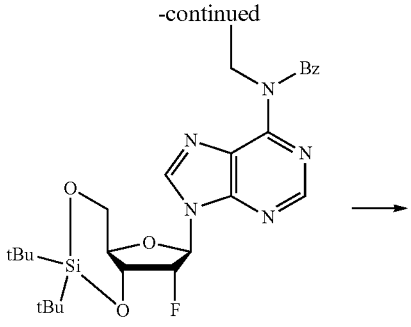

3d

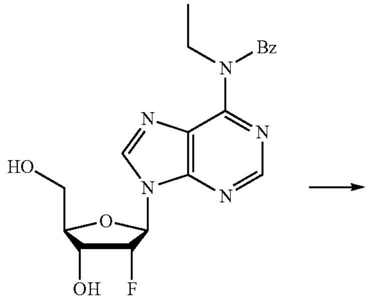

4d

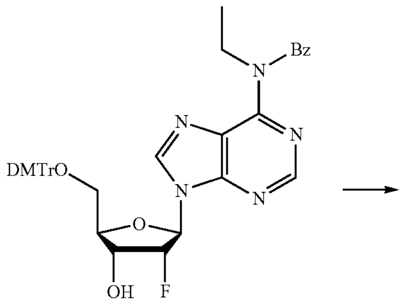

5d

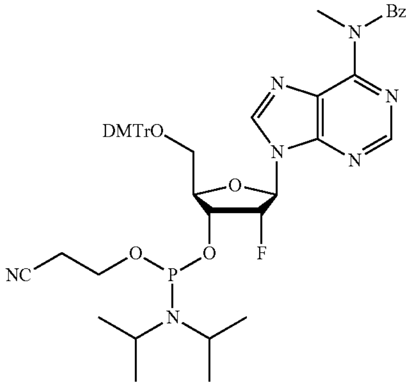

6d

Step 1 Synthesis of Compound 3d

N-(9-((4aR,6R,7R,7aS)-2,2-di-tert-butyl-7-fluorotetrahydro-4H-furo[3,2-d][1,3,2]dioxasilin-6-yl)-9H-purin-6-yl)-N-ethylbenzamide The compound 2b (1.00 g, 1.95 mmol) was dissolved in dichloromethane (5.0 mL), and tetrabutylammonium bromide (0.942 g, 2.92 mmol) and a 1 M sodium hydroxide aqueous solution (5.0 ml) were added thereto. Methyl iodide (0.942 ml, 11.7 mmol) was slowly added thereto in a dropwise manner. Thereafter, the resultant was stirred at room temperature for 2 hours. After confirming disappearance of the raw material, the resultant reaction solution was added to ice cooled water/chloroform=1/1 for quenching. An organic layer was washed with water twice, and was dehydrated with anhydrous sodium sulfate, the desiccant was filtered out, and the resultant filtrate was concentrated. The thus obtained concentrated residue was purified by silica gel column chromatography (heptane/ethyl acetate=80/20 to 70/30) to obtain a compound 3d (629 mg, 1.16 mmol) in the form of a colorless amorphous. (yield 60%)

ESI-MS: calcd: 542.26 $[M+H]^+$, found: 542.6 $[M+H]^+$.

$^1$H-NMR ($CDCl_3$, 400 MHz) δ: 8.55 (s, 1H), 7.91 (s, 1H), 7.46 (d, J=7.3 Hz, 2H), 7.30 (t, J=7.1 Hz, 1H), 7.19 (t, J=7.8 hz, 2H), 6.09 (d, J=22.4 Hz, 1H), 5.45 (dd, J=54.1, 3.9 Hz, 1H), 4.86 (ddd, J=27.2, 9.8, 4.1 Hz, 1H), 4.48 (dd, J=9.1, 5.0, 1H), 4.40 (q, J=7.2 Hz, 2H), 4.04 (t, J=9.8 Hz, 1H), 1.34 (t, J=7.1 Hz, 3H), 1.11 (s, 9H), 1.05 (s, 9H).

Step 2 Synthesis of Compound 4d

N-ethyl-N-(9-((2R,3R,4R,5R)-3-fluoro-4-hydroxy-5-(hydroxymethyl)tetrahydrofuran-2-yl)-9H-purin-6-yl)benzamide A compound 4d was obtained in the same manner as in the procedures for obtaining the compound 4c.

ESI-MS: calcd: 401.40 $[M+H]^+$, found: 402.1 $[M+H]^+$.

Step 3 Synthesis of Compound 5d

N-(9-((2R,3R,4R,5R)-5-((bis(4-methoxyphenyl)(phenyl)methoxy)methyl)-3-fluoro-4-hydroxytetrahydrofuran-2-yl)-9H-purin-6-yl)-N-ethylbenzamide A compound 5d was obtained in the same manner as in the procedures for obtaining the compound 5c.

ESI-MS: calcd: 738.25 $[M+Cl]^-$, found: 738.7 $[M+Cl]^-$.

$^1$H-NMR ($CDCl_3$, 400 MHz) δ: 8.52 (s, 1H), 8.07 (s, 1H), 7.43-7.41 (m, 2H), 7.38-7.35 (m, 2H), 7.30-7.20 (m, 8H), 7.10 (t, J=7.8 Hz, 2H), 6.79 (d, J=8.2 Hz, 4H), 6.22 (dd, J=17.4, 2.3 Hz, 1H), 5.58 (ddd, J=53.0, 2.4, 1.2 Hz, 1H), 4.93-4.74 (m, 1H), 4.40 (q, J=7.2 Hz, 2H), 4.19-4.16 (m, 1H), 3.78 (s, 6H), 3.54 (dd, J=11.0, 3.2 Hz, 1H), 3.40 (dd, J=10.5, 3.1 Hz, 1H), 2.23 (dd, J=6.9, 2.3 Hz, 1H), 1.33 (t, J=7.1 Hz, 3H).

Step 4 Synthesis of Amidite 6d (2R,3R,4R,5R)-2-((bis(4-methoxyphenyl)(phenyl)methoxy)methyl)-5-(6-(N-ethylbenzamido)-9H-purin-9-yl)-4-fluorotetrahydrofuran-3-yl(2-cyanoethyl) diisopropylphosphoramidite The compound 5d (1.93 g, 2.74 mmol) was dissolved in dichloromethane (16 mL), and diisopropylethylamine (0.958 mL, 5.48 mmol) was added thereto, followed by cooling on an ice bath. To the resultant, 2-cyanoethyldiisopropylchlorophosphoramidite (970 mg, 4.11 mmol) dissolved in dehydrated dichloromethane (3.8 mL) was added in a dropwise manner. Thereafter, the resultant was stirred for 1 hour with increasing the temperature up to room temperature. After confirming disappearance of the raw material, the resultant reaction solution was added to ice cooled saturated sodium bicarbonate water for quenching. To the resultant, ethyl acetate was added for extraction. An organic layer was washed with a saturated saline solution, and was dried over anhydrous sodium sulfate. After filtration, the resultant filtrate was concentrated. The thus obtained concentrated residue was purified by silica gel column chromatography (heptane/ethyl acetate (containing 1% triethylamine)=90/10 to 60/40) to obtain an amidite 6d (2.29 g, 2.53 mmol) in the form of a colorless amorphous. (yield: 92%)

ESI-MS: calcd: 938.36 $[M+Cl]^-$, found: 938.7 $[M+Cl]^-$.

$^1$H-NMR ($CDCl_3$, 400 MHz) δ: 8.53 (s, 0.5H), 8.51 (s, 0.5H), 8.11 (s, 1H), 7.41-7.33 (m, 4H), 7.27-7.16 (m, 8H), 7.03 (t, J=7.8 Hz, 2H), 6.79-6.75 (m, 4H), 6.27-6.18 (m, 1H), 5.78-5.58 (m, 1H), 5.10-4.85 (m, 1H), 4.42-4.38 (m, 2H), 4.31-4.30 (m, 1H), 3.96-3.72 (m, 7H), 3.68-3.51 (m, 4H), 3.29-3.27 (m, 1H), 2.59 (t, J=6.2 Hz, 1H), 2.40 (t, J=6.4 Hz, 1H), 1.33-1.31 (m, 3H), 1.19-1.15 (m, 9H), 1.04 (d, J=6.9 Hz, 3H).

$^{31}$P-NMR($CDCl_3$, 162 MHz) δ: 151.94, 151.89, 151.20, 151.11.

For an RNA oligonucleotide, 2'-TOM (triisopropylsilyloxymethyl) protected β-cyanoethyl phosphoramidite (DMT-2'-O-TOM-rA (Ac), DMT-2'-O-TOM-rG (Ac), DMT-2'-O-TOM-rC (Ac), or DMT-2'-O-TOM-rU) (each Glen Research Corporation or ChemGenes Corp.) was used, and for a DNA oligonucleotide, β-cyanoethyl phosphoramidite (DMT-dA (Bz), DMT-dG (iBu), DMT-dC (Ac), or DMT-T) was used. Each phosphoramidite monomer was prepared in the form of a 0.05 mol/L acetonitrile solution, and was synthesized with a DNA/RNA solid phase synthesizer (NTS M-2-MX, Nihon Techno Service Co., Ltd.) using 0.2 μmol or 0.8 μmol of a solid phase support.

For obtaining the DNA oligonucleotide, CPG 1000 Angstrom (dA-CPG, dG-CPG, Ac-dC-CPG, or dT-CPG) (Glen Research Corporation) was used as a solid phase support, and a condensation time was set to 2 minutes.

For obtaining an RNA having a phosphate group at the 5' end (5'-monophosphate RNA), Universal UnyLinker Support 2000 Angstrom (ChemGenes Corp.) was used as a solid phase support, and a condensation time for the first base was set to 15 minutes, and for following bases was set to 3 minutes each. Phosphorylation of a hydroxyl group at the 5' end was performed with a chemical phosphorylation reagent (0.05 mol/L acetonitrile solution) (Glen Research Corporation or ChemGenes Corp.).

Solid phase synthesis of an RNA oligonucleotide having a 3'-aminoguanosine monomer introduced to the 3' end was performed using the compound 15. A condensation time for the first base was set to 15 minutes, and for the following bases was set to 3 minutes each.

Reagents used in the solid phase synthesizer were as follows: Removal of a dimethoxytrityl group of a 5' end hydroxyl group was performed using a commercially available deblocking reagent (Deblocking Solution-1, 3 w/v % trichloroacetic acid/dichloromethane solution) (Wako Pure Chemical Industries Ltd.) by causing a reaction for 10 seconds. As an activator of a phosphoramidite, a commercially available activator solution (activator solution 3) (Wako Pure Chemical Industries Ltd.) was used. Capping of an unreacted 5' end hydroxyl group was performed using a commercially available capping solution (Cap A solution-2 and Cap B solution-2) (Wako Pure Chemical Industries Ltd.) by causing a reaction for 10 seconds. As an oxidant used in producing a phosphoric acid ester, a solution containing pyridine, THF, water and iodine (Oxidizer, 0.01 M iodine, 29.2% water, 6.3% pyridine, 64.5% acetonitrile), Honeywell Inc.) was used, and a reaction was performed for 10 seconds. After solid phase synthesis, the dimethoxytrityl group of the 5' end hydroxyl group of the RNA oligonucleotide was deprotected on the solid phase support. The synthesized DNA and RNA oligonucleotides were all deresined/deprotected by an ordinary method (concentrated ammonia water, 55° C., 12 hours). The DNA oligonucleotide was purified with a cartridge column (MicroPure II Column, LGC Biosearch Technologies Inc.) in accordance with product protocol. For the RNA oligonucleotide, a solution obtained by deresination was completely dried and hardened by concentration with a centrifugal evaporator, and thereafter, the TOM protected group of the 2' hydroxyl group was removed with tetrabutylammonium fluoride (1 M tetrahydrofuran solution) (1 mL) (at 50° C. for 10 minutes, and subsequently at room temperature for 12 hours, or at 50° C. for 10 minutes, and subsequently at 35° C. for 6 hours). A Tris-hydrochloric acid buffer (hereinafter referred to as Tris-HCl) (1 M, pH 7.4) (1 mL) was added to and mixed with the resultant solution, and tetrahydrofuran was removed by concentration with a centrifugal evaporator. The thus obtained solution was treated with a gel filtration column (NAP-25, GE Healthcare Ltd.) equilibrated with ultrapure water in accordance with product protocol. The thus obtained fraction containing the RNA oligonucleotide was concentrated with a centrifugal evaporator, followed by purification with modified polyacrylamide gel (hereinafter referred to as dPAGE).

(Purification of RNA Fragment with dPAGE)

To an acrylamide gel solution (containing 7M urea as a modifier), an aqueous solution of ammonium persulfate (hereinafter referred to as APS) and N,N,N',N'-tetramethylethylenediamine (hereinafter referred to as TEMED) were added as a polymerizing agent, and the resultant was solidified (room temperature, 6 to 12 hours) to produce a gel. An RNA sample was mixed with a gel loading buffer (80% formamide, TBE), and the resultant mixture was heated at 90° C. for 3 minutes, and then loaded on the gel. After electrophoresis, a band of the RNA was detected with UV light irradiation (254 nm), and was cut out from the gel with a razor blade. The thus cut gel piece was finely crushed, and extracted from the gel with ultrapure water (shaking at room temperature for 6 to 12 hours). The RNA extract thus obtained was desalted/concentrated with Amicon Ultra 10K (Millipore Corp.), and subjected to ethanol precipitation (0.3 M sodium acetate (pH 5.2)/70% ethanol) to obtain an RNA pellet. The RNA pellet was rinsed with 80% ethanol, and was air-dried at room temperature for 1 hour. The resultant RNA pellet was dissolved in ultrapure water, the resultant was diluted to an appropriate concentration, and was measured for an absorbance at 260 nm by ultraviolet visible spectrophotometry (NanoDrop, Thermo Scientific), and the concentration was determined based on a molar extinction coefficient of each RNA sequence (with the following numerical values used as molar extinction coefficients of respective bases: A=15300, G=11800, C=7400, T=9300, and U=9900).

The structure of the purified oligonucleotide was determined by mass spectrometry with MALDI-TOF MS (Ultraflex III, Bruker Daltonics) (matrix: 3-hydroxypicolinic acid) or through analysis by modified polyacrylamide gel electrophoresis.

(Analysis of Chemical Ligation Reaction with dPAGE)

In analysis of a chemical ligation reaction, a reaction solution appropriately diluted with ultrapure water was used as a sample. The diluted sample was mixed with a gel loading buffer (80% formamide/TBE), and the resultant mixture was heated at 90° C. for 3 minutes, and then loaded on a gel. After electrophoresis, gel staining (room temperature, 15 minutes) was performed with SYBR® Green II Nucleic Acid Stain (Lonza) diluted 10,000-fold with ultrapure water, and thus a band of the RNA was detected (used device: ChemiDoc, BIORAD).

A yield in a chemical ligation reaction was calculated through comparison of band intensity of an RNA ligation product with a ligation product isolated and purified with dPAGE used as a reference substance.

(Purification of Chemical Ligation Product with dPAGE)

An RNA ligation product obtained by a chemical ligation reaction was collected as an RNA pellet from a reaction solution by ethanol precipitation (0.3 M sodium acetate (pH 5.2)/70% ethanol), and then purified with dPAGE.

Sequence information of compounds (polynucleotides) used in Examples 1 to 4 is as follows. Each nucleotide N in Tables 1 and 2 indicates an RNA, N(M) indicates a 2'-O-methyl modified RNA, N(F) indicates a 2'-F modified RNA, and dN indicates a DNA. Besides, p indicates that the 3' or 5' end is phosphorylated. Underlined "AUG" indicates a start codon, and underlined "UGA" indicates a stop codon. A slash (/) in a sequence indicates that polynucleotides are linked at the portion.

TABLE 1

| Example No. | Compound Name | Sequence (5' to 3') | SEQ ID NO: |
|---|---|---|---|
| Example 1 | E1 | GG(F)GAG(F)AAU(F)ACA(F)AGC(F)UAC(F)UUG(F)UUC(F)UUU(F)UUG(F)CAG(F)CCA(F)CC**A(F)UG**G(F)ACU(F)ACA(F)AGG(F)ACG(F)ACG(F)ACG(F)ACA(F)AGA(F)UCA(F)UCG(F)ACU(F)AUA(F)AA**G/A**CGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)AC**U(F)GA** | 1 |
| | E1-1 | GG(F)GAG(F)AAU(F)ACA(F)AGC(F)UAC(F)UUG(F)UUC(F)UUU(F)UUG(F)CAG(F)CCA(F)CCA(F)UGG(F)ACU(F)ACA(F)AGG(F)ACG(F)ACG(F)ACG(F)ACA(F)AGA(F)UCA(F)UCG(F)ACU(F)AUA(F)AAG | 2 |
| | E1-2 | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(F)GA | 3 |
| | Template DNA1 | dCdCdTdTdTdAdTdCdGdTdCdGdTdCdGdTdCdTdTdTdAdTdAdGdTdCdGdAdTdG | 4 |

TABLE 1-continued

| Example No. | Compound Name | Sequence (5' to 3') | SEQ ID NO: |
|---|---|---|---|
| Example 2 | E2 | GG(F)GAG(F)AAU(F)ACA(F)AGC(F)UAC(F)UUG(F)UUC(F)UUU(F)UUG(F)C<br>AG(F)CCA(F)CC**A(F)UG**G(F)ACU(F)ACA(F)AGG(F)ACG(F)ACG(F)ACG(F)A<br>CA(F)AGA(F)UCA(F)UCG(F)ACU(F)AUA(F)AA**G/A**CGACG(F)ACG(F)AUA(F)<br>AAG(F)GUG(F)GCG(F)ACU(F)AUA(F)AGG(F)ACG(F)ACG(F)ACG(F)ACA(F)<br>AAC(F)ACC(F)ACC(F)ACC(F)ACC(F)ACC(F)AC**U(F)GA**A(F)AAA(F)AAA(F)<br>AAA(F)AAA(F)AAA(F)AAA(F)A | 5 |
| | E2-1 | GG(F)GAG(F)AAU(F)ACA(F)AGC(F)UAC(F)UUG(F)UUC(F)UUU(F)UUG(F)C<br>AG(F)CCA(F)CCA(F)UGG(F)ACU(F)ACA(F)AGG(F)ACG(F)ACG(F)ACG(F)A<br>CA(F)AGA(F)UCA(F)UCG(F)ACU(F)AUA(F)AAG | 6 |
| | E2-2 | pACGACG(F)ACG(F)AUA(F)AAG(F)GUG(F)GCG(F)ACU(F)AUA(F)AGG(F)AC<br>G(F)ACG(F)ACG(F)ACA(F)AAC(F)ACC(F)ACC(F)ACC(F)ACC(F)ACC(F)AG<br>U(F)GAA(F)AAA(F)AAA(F)AAA(F)AAA(F)AAA(F)AAA(F)A | 7 |
| | Template DNA1 | dCdCdTdTdTdAdTdCdGdTdCdGdTdCdGdTdCdTdTdTdAdTdAdGdTdCdGdAdTdG | 4 |

TABLE 2

| Example No. | Compound Name | Sequence (5' to 3') | SEQ ID NO: |
|---|---|---|---|
| Example 3 | E3 | GG(F)GAG(F)AAU(F)ACA(F)AGC(F)UAC(F)UUG(F)UUC(F)UUU(F)UUG(F)C<br>AG(F)CCA(F)CC**A(F)UG**G(F)ACU(F)ACA(F)AGG(F)ACG(F)ACG(F)ACG(F)A<br>CA(F)AGA(F)UCA(F)UCG(F)ACU(F)AUA(F)AA**G/A**CGACG(F)ACG(F)AUA(F)<br>AAG(F)GUG(F)GCG(F)ACU(F)AUA(F)AGG(F)ACG(F)ACG(F)ACG(F)ACA(F)<br>AAC(F)ACC(F)ACC(F)ACC(F)ACC(F)ACC(F)AC**U(F)GA**AAAAAAAAAAAAAAAA<br>AAAA | 8 |
| | E3-1 | GG(F)GAG(F)AAU(F)ACA(F)AGC(F)UAC(F)UUG(F)UUC(F)UUU(F)UUG(F)C<br>AG(F)CCA(F)CCA(F)UGG(F)ACU(F)ACA(F)AGG(F)ACG(F)ACG(F)ACG(F)A<br>CA(F)AGA(F)UCA(F)UCG(F)ACU(F)AUA(F)AAG | 9 |
| | E3-2 | pACGACG(F)ACG(F)AUA(F)AAG(F)GUG(F)GCG(F)ACU(F)AUA(F)AGG(F)AC<br>G(F)ACG(F)ACG(F)ACA(F)AAC(F)ACC(F)ACC(F)ACC(F)ACC(F)ACC(F)AC<br>U(F)GAAAAAAAAAAAAAAAAAAAAA | 10 |
| | Template DNA1 | dCdCdTdTdTdAdTdCdGdTdCdGdTdCdGdTdCdTdTdTdAdTdAdGdTdCdGdAdTdG | 4 |
| Example 4 | E4 | G(M)G(M)G(M)A(M)G(M)A(M)AUACAAGCUACUUGUUCUUUUUGCAGCCACC**AUG**G<br>(F)ACU(F)ACA(F)AGG(F)ACG(F)ACG(F)ACG(F)ACA(F)AGA(F)UCA(F)UCG<br>(F)ACU(F)AUA(F)AAG/ACGACG(F)ACG(F)AUA(F)AAG(F)GUG(F)GCG(F)AC<br>U(F)AUA(F)AGG(F)ACG(F)ACG(F)ACG(F)ACA(F)AAC(F)ACC(F)ACC(F)AC<br>C(F)ACC(F)ACC(F)AC**U(M)G(M)A(M)** | 11 |
| | E4-1 | G(M)G(M)G(M)A(M)G(M)A(M)AUACAAGCUACUUGUUCUUUUUGCAGCCACCAUGG<br>(F)ACU(F)ACA(F)AGG(F)ACG(F)ACG(F)ACG(F)ACA(F)AGA(F)UCA(F)UGG<br>(F)ACU(F)AUA(F)AAG | 12 |
| | E4-2 | pACGACG(F)ACG(F)AUA(F)AAG(F)GUG(F)GCG(F)ACU(F)AUA(F)AGG(F)AC<br>G(F)ACG(F)ACG(F)ACA(F)AAC(F)ACC(F)ACC(F)ACC(F)ACC(F)ACC(F)AC<br>U(M)G(M)A(M) | 13 |
| | Template DNA1 | dCdCdTdTdTdAdTdCdGdTdCdGdTdCdGdTdCdTdTdTdAdTdAdGdTdCdGdAdTdG | 4 |

Example 1

Ultrapure water solutions (200 μL, nucleic acid final concentration: 50 μM) of an RNA fragment E1-1 (10 nmol) obtained as a sequence 2 and a 5' phosphate RNA fragment E1-2 (10 nmol) obtained as a sequence 3 by chemical synthesis, and a template DNA 1 (10 nmol) were prepared in 3 batches. To each of the prepared solutions, 100 μL of T4 RNA Ligase 2 Reaction Buffer (10×) (manufactured by New England BioLabs, Inc.) and 440 μL of ultrapure water were added, and the resultant was heated at 90° C. for 5 minutes, and was returned to room temperature over 30 minutes or more. To each of the resultant solutions, a 60% PEG 6000 aqueous solution was added to a final concentration of 15%. To the resultant solution, T4 RNA Ligase 2 (manufactured by New England BioLabs, Inc.) (10 units/μL) (10 μL) was added to be mixed, and the resultant was allowed to stand still on a temperature controlled heat block (37° C., 16 hours). To the resultant reaction solution, chloroform in the same volume was added to be mixed by vortex, the resultant was centrifuged, and then, an upper layer was taken out and subjected to alcohol precipitation (0.3 M sodium acetate aqueous solution (pH 5.2)/70% ethanol), and thus, an RNA pellet was obtained. RNAs obtained in the respective batches were collected, and the resultant was purified with a 7.5% modified polyacrylamide gel to obtain an RNA ligation product E1 (9.7 nmol, yield: 32%).

Example 2

An RNA fragment E2-1 obtained as a sequence 6 and a 5' phosphate RNA fragment E2-2 obtained as a sequence 7 by chemical synthesis, and the template DNA 1 were used in the same manner as in Example 1 to obtain an RNA ligation product E2 (10.9 nmol, yield: 36%).

Example 3

An RNA fragment E3-1 obtained as a sequence 9 and a 5' phosphate RNA fragment E3-2 obtained as a sequence 10 by chemical synthesis, and the template DNA 1 were used in the same manner as in Example 1 to obtain an RNA ligation product E3 (13.4 nmol, yield: 45%).

Example 4

An RNA fragment E4-1 obtained as a sequence 12 and a 5' phosphate RNA fragment E4-2 obtained as a sequence 13 by chemical synthesis, and the template DNA 1 were used in the same manner as in Example 1 to obtain an RNA ligation product E4 (6.8 nmol, yield: 34%).

Sequence information of compounds (polynucleotides) used in Reference Examples 1 to 18 is as follows. Each nucleotide N in Tables 3 and 8 indicates an RNA, N(M) indicates a 2'-O-methyl modified RNA, N(F) indicates a 2'-F modified RNA, N(L) indicates an LNA, N(MOE) indicates a 2'-O-methoxyethyl modified RNA, and dN indicates a DNA. A(m6) indicates that a base portion is N6-methyladenine. Besides, p indicates that the 3' or 5' end is phosphorylated, and p(S) indicates that the 3' or 5' end is phosphorothioated. NH2 indicates that a hydroxyl group at the 3' or 5' end is replaced with an amino group. —N/P— and —P/N— indicates that a phosphate bond of a nucleotide is replaced with a phosphoric acid amide bond, and —NHAc/S— indicates that a phosphate bond of a nucleotide is replaced with —NHC(O)—CH2-S—P(O)(OH)—O—. Underlined "AUG" indicates a start codon, and underlined "UGA" indicates a stop codon. A slash (/) in a sequence indicates that polynucleotides are linked at the portion.

TABLE 3

| Reference Example No. | Compound Name | Sequence (5' to 3') | SEQ ID NO: |
|---|---|---|---|
| Reference Example 1 | R1 | AUUAUUAAGGAGAUAUAUCCG**AUG**AUUAUUGACUACAAGGACGACGAUGACAAAAUUAUUGACUACAAG**G-N/P-A**CGACGAUGACAAACUGCUGAUUAUUGACUACAAGGACGACGAUGACAAAAUUAUU | 14 |
| | R1-1 | AUUAUUAAGGAGAUAUAUCCGAUGAUUAUUGACUACAAGGACGACGAUGACAAAAUUAUUGACUACAAGG-NH2 | 15 |
| | R1-2 | pACGACGAUGACAAACUGCUGAUUAUUGACUACAAGGACGACGAUGACAAAAUUAUU | 16 |
| | Template DNA2 | dCdAdGdCdAdGdTdTdTdGdTdCdAdTdCdGdTdCdGdTdCdCdTdTdGdTdAdGdTdCdAdAdTdAdAdTdTdTdTdG | 17 |
| Reference Example 2 | R2 | GGGAGAAUACAAGCUACUUGUUCUUUUUGCAGCCACC**AUG**GACUACAAGGACGACGACGACAAGAUCAUCGACUAUAAA**G-N/P-A**CGACGACGAUAAAGGUGGCGACUAUAAGGACGACGACGACAAACACCACCACCACCACCAC**UGA** | 18 |
| | R2-1 | GGGAGAAUACAAGCUACUUGUUCUUUUUGCAGCCACCAUGGACUACAAGGACGACGACGACAAGAUCAUCGACUAUAAAG-NH2 | 19 |
| | R2-2 | pACGACGACGAUAAAGGUGGCGACUAUAAGGACGACGACGACAAACACCACCACCACCACCACUGA | 20 |
| | Template DNA1 | dCdCdTdTdTdAdTdCdGdTdCdGdTdCdGdTdCdTdTdTdAdTdAdGdTdCdGdAdTdG | 4 |
| Reference Example 3 | R3 | GGGAGAAUACAAGCUACUUGUUCUUUUUGCAGCCACC**AUG**GACUACAA**G-N/P-G**ACGACGACGACAAGAUCAUCGACUAUAAAGACGACGACGAUAAAGGUGGCGACUAUAAGGACGACGACGACAAACACCACCACCACCACCAC**UGA** | 21 |
| | R3-1 | GGGAGAAUACAAGCUACUUGUUCUUUUUGCAGCCACCAUGGACUACAAG-NH2 | 22 |
| | R3-2 | pGACGACGACGACAAGAUCAUCGACUAUAAAGACGACGACGAUAAAGGUGGCGACUAUAAGGACGACGACGACAAACACCACCACCACCACCACUGA | 23 |
| | Template DNA3 | dGdTdCdGdTdCdGdTdCdGdTdCdCdTdTdGdTdAdGdTdCdCdAdT | 24 |

TABLE 4

| Reference Example No. | Compound Name | Sequence (5' to 3') | SEQ ID NO: |
|---|---|---|---|
| Reference Example 4 | R4 | GGGAGAAUACAAGCUACUUGUUCUUUUU**G-N/P-C**AGCCA<br>CC**AUG**GACUACAAGGACGACGACGACAAGAUCAUCGACUA<br>UAAA**G-N/P-A**CGACGACGAUAAAGGUGGCGACUAUAAGG<br>ACGACGACGACAAACACCACCACCACCACCAC**UGA** | 25 |
| | R4-1 | GGGAGAAUACAAGCUACUUGUUCUUUUUG-NH2 | 26 |
| | R4-2 | pCAGCCACCAUGGACUACAAGGACGACGACGACAAGAUCA<br>UCGACUAUAAAG-NH2 | 27 |
| | R4-3 | pACGACGACGAUAAAGGUGGCGACUAUAAGGACGACGACG<br>ACAAACACCACCACCACCACCACUGA | 28 |
| | Template DNA1 | dCdCdTdTdTdAdTdCdGdTdCdGdTdCdGdTdCdTdTdT<br>dAdTdAdGdTdCdGdAdTdG | 4 |
| | Template DNA4 | dGdTdCdCdAdTdGdGdTdGdGdCdTdGdCdAdAdAdAdA<br>dGdAdAdCdAdAdGdT | 29 |
| Reference Example 5 | R5 | GGGAGAAUACAAGCUACUUGUUCUUUUUGCAGCCACC**AUG**<br>GACUACAAGGACGACGACGACAAGAUCAUCGACUAUAAA<br>**G-NHAc/S-A**CGACGACGAUAAAGGUGGCGACUAUAAGGA<br>CGACGACGACAAACACCACCACCACCACCAC**UGA** | 30 |
| | R5-1 | GGGAGAAUACAAGCUACUUGUUCUUUUUGCAGCCACCAUG<br>GACUACAAGGACGACGACGACAAGAUCAUCGACUAUAAA<br>G-NH2 | 31 |
| | R5-2 | p(S)ACGACGACGAUAAAGGUGGCGACUAUAAGGACGACG<br>ACGACAAACACCACCACCACCACCACUGA | 32 |
| | Template DNA1 | dCdCdTdTdTdAdTdCdGdTdCdGdTdCdGdTdCdTdTdT<br>dAdTdAdGdTdCdGdAdTdG | 4 |
| Reference Example 6 | R6 | GGGAGAAUACAAGCUACUUGUUCUUUUUGCAGCCACC**AUG**<br>GACUACAAGGACGACGACGACAAGAUCAUCGACUAUAAA<br>**G/A**CGACGACGAUAAAGGUGGCGACUAUAAGGACGACGAC<br>GACAAACACCACCACCACCACCAC**UGA**AAAAAAAAAAAAA<br>AAAAAAA | 33 |
| | R6-1 | GGGAGAAUACAAGCUACUUGUUCUUUUUGCAGCCACCAUG<br>GACUACAAGGACGACGACGACAAGAUCAUCGACUAUAAAG | 34 |
| | R6-2 | pACGACGACGAUAAAGGUGGCGACUAUAAGGACGACGACG<br>ACAAACACCACCACCACCACCACUGAAAAAAAAAAAAAAA<br>AAAAAA | 35 |
| | Template DNA1 | dCdCdTdTdTdAdTdCdGdTdCdGdTdCdGdTdCdTdTdT<br>dAdTdAdGdTdCdGdAdTdG | 4 |

TABLE 5

| Reference Example No. | Compound Name | Sequence (5' to 3') | SEQ ID NO: |
|---|---|---|---|
| Reference Example 7 | R7 | G(F)G(F)G(F)A(F)G(F)A(F)A(F)U(F)A(F)C(F)A(F)A(F)G(F)<br>C(F)U(F)A(F)C(F)U(F)U(F)G(F)U(F)U(F)C(F)U(F)U(F)U(F)<br>U(F)U(F)G(F)C(F)A(F)GCCACC**AUG**GACUACAAGGACGACGACGACAA<br>GAUCAUCGACUAUAAAG/ACGACGACGAUAAAGGUGGCGACUAUAAGGACGA<br>CGACGACAAACACCACCACCACCACCAC**UGA** | 36 |
| | R7-1 | G(F)G(F)G(F)A(F)G(F)A(F)A(F)U(F)A(F)C(F)A(F)A(F)G(F)<br>C(F)U(F)A(F)C(F)U(F)U(F)G(F)U(F)U(F)C(F)U(F)U(F)U(F)<br>U(F)U(F)G(F)C(F)A(F)GCCACCAUGGACUACAAGGACGACGACGACAA<br>GAUCAUCGACUAUAAAG | 37 |
| | R7-2 | pACGACGACGAUAAAGGUGGCGACUAUAAGGACGACGACGACAAACACCACC<br>ACCACCACCACUGA | 38 |
| | Template DNA1 | dCdCdTdTdTdAdTdCdGdTdCdGdTdCdGdTdCdTdTdTdAdTdAdGdTdC<br>dGdAdTdG | 4 |

TABLE 5-continued

| Reference Example No. | Compound Name | Sequence (5' to 3') | SEQ ID NO: |
|---|---|---|---|
| Reference Example 8 | R8 | G(M)G(M)G(M)A(M)G(M)A(M)A(M)U(M)A(M)C(M)A(M)A(M)G(M)<br>C(M)U(M)A(M)C(M)U(M)U(M)G(M)U(M)U(M)C(M)U(M)U(M)U(M)<br>U(M)U(M)G(M)C(M)A(M)GCCACC**AUG**GACUACAAGGACGACGACGACAA<br>GAUCAUCGACUAUAAA**G/A**CGACGACGAUAAAGGUGGCGACUAUAAGGACGA<br>CGACGACAAACACCACCACCACCACCAC**UGA** | 39 |
| | R8-1 | G(M)G(M)G(M)A(M)G(M)A(M)A(M)U(M)A(M)C(M)A(M)A(M)G(M)<br>C(M)U(M)A(M)C(M)U(M)U(M)G(M)U(M)U(M)C(M)U(M)U(M)U(M)<br>U(M)U(M)G(M)C(M)A(M)GCCACCAUGGACUACAAGGACGACGACGACAA<br>GAUCAUCGACUAUAAAG | 40 |
| | R8-2 | pACGACGACGAUAAAGGUGGCGACUAUAAGGACGACGACGACAAACACCACC<br>ACCACCACCACUGA | 41 |
| | Template DNA1 | dCdCdTdTdTdAdTdCdGdTdCdGdTdCdGdTdCdTdTdTdAdTdAdGdTdC<br>dGdAdTdG | 4 |
| Reference Example 9 | R9 | G(F)G(M)G(F)A(M)G(F)A(M)A(F)U(M)A(F)C(M)A(F)A(M)G(F)<br>C(M)U(F)A(M)C(F)U(M)U(F)G(M)U(F)U(M)C(F)U(M)U(F)U(M)<br>U(F)U(M)G(F)C(M)A(F)GCCACC**AUG**GACUACAAGGACGACGACGACAA<br>GAUCAUCGACUAUAAA**G/A**CGACGACGAUAAAGGUGGCGACUAUAAGGACGA<br>CGACGACAAACACCACCACCACCACCAC**UGA** | 42 |
| | R9-1 | G(F)G(M)G(F)A(M)G(F)A(M)A(F)U(M)A(F)C(M)A(F)A(M)G(F)<br>C(M)U(F)A(M)C(F)U(M)U(F)G(M)U(F)U(M)C(F)U(M)U(F)U(M)<br>U(F)U(M)G(F)C(M)A(F)GCCACCAUGGACUACAAGGACGACGACGACAA<br>GAUCAUCGACUAUAAAG | 43 |
| | R9-2 | pACGACGACGAUAAAGGUGGCGACUAUAAGGACGACGACGACAAACACCACC<br>ACCACCACCACUGA | 44 |
| | Template DNA1 | dCdCdTdTdTdAdTdCdGdTdCdGdTdCdGdTdCdTdTdTdAdTdAdGdTdC<br>dGdAdTdG | 4 |

TABLE 6

| Reference Example No. | Compound Name | Sequence (5' to 3') | SEQ ID NO: |
|---|---|---|---|
| Reference Example 10 | R10 | G(M)G(M)G(M)A(M)G(M)A(M)A(M)U(M)A(M)C(M)A(M)A(M)G(M)<br>C(M)U(M)A(M)C(M)U(M)U(M)G(M)U(M)U(M)C(M)U(M)U(M)U(M)<br>U(M)U(M)G(M)C(M)A(M)G(M)C(M)C(M)A(M)C(M)C(M)**A(M)U(M)**<br>**G(M)**G(M)A(M)C(M)U(M)A(M)C(M)A(M)A(M)G(M)G(M)A(M)C(M)<br>G(M)A(M)C(M)G(M)A(M)C(M)G(M)A(M)C(M)A(M)A(M)G(M)A(M)<br>U(M)C(M)A(M)U(M)C(M)G(M)A(M)C(M)U(M)A(M)U(M)A(M)A(M)<br>A(M)**G/A**CGA(M)C(M)G(M)A(M)C(M)G(M)A(M)U(M)A(M)A(M)A<br>(M)G(M)G(M)U(M)G(M)G(M)C(M)G(M)A(M)C(M)U(M)A(M)U(M)A<br>(M)A(M)G(M)G(M)A(M)C(M)G(M)A(M)C(M)G(M)A(M)C(M)G(M)A<br>(M)C(M)A(M)A(M)A(M)C(M)A(M)C(M)C(M)A(M)C(M)C(M)A(M)C<br>(M)C(M)A(M)C(M)C(M)A(M)C(M)C(M)A(M)C(M)**U(M)G(M)A(M)** | 45 |
| | R10-1 | G(M)G(M)G(M)A(M)G(M)A(M)A(M)U(M)A(M)C(M)A(M)A(M)G(M)<br>C(M)U(M)A(M)C(M)U(M)U(M)G(M)U(M)U(M)C(M)U(M)U(M)U(M)<br>U(M)U(M)G(M)C(M)A(M)G(M)C(M)C(M)A(M)C(M)C(M)A(M)U(M)<br>G(M)G(M)A(M)C(M)U(M)A(M)C(M)A(M)A(M)G(M)G(M)A(M)C(M)<br>G(M)A(M)C(M)G(M)A(M)C(M)G(M)A(M)C(M)A(M)A(M)G(M)A(M)<br>U(M)C(M)A(M)U(M)C(M)G(M)A(M)C(M)U(M)A(M)U(M)A(M)A(M)<br>A(M)G | 46 |
| | R10-2 | pACGA(M)C(M)G(M)A(M)C(M)G(M)A(M)U(M)A(M)A(M)A(M)G(M)<br>G(M)U(M)G(M)G(M)C(M)G(M)A(M)C(M)U(M)A(M)U(M)A(M)A(M)<br>G(M)G(M)A(M)C(M)G(M)A(M)C(M)G(M)A(M)C(M)G(M)A(M)C(M)<br>A(M)A(M)A(M)C(M)A(M)C(M)C(M)A(M)C(M)C(M)A(M)C(M)C(M)<br>A(M)C(M)C(M)A(M)C(M)C(M)A(M)C(M)U(M)G(M)A(M) | 47 |
| | Template DNA1 | dCdCdTdTdTdAdTdCdGdTdCdGdTdCdGdTdCdTdTdTdAdTdAdGdTdC<br>dGdAdTdG | 4 |
| Reference Example 11 | R11 | GGGAGAAUACAAGCUACUUGUUCUUUUUGCAGCCACC**AUG**GACUACAAGGAC<br>GACGACGACAAGAUCAUCGACUAUAAA**G(F)-P/N-A**CGACGACGAUAAAGG<br>UGGCGACUAUAAGGACGACGACGACAAACACCACCACCACCACCAC**UGA** | 48 |

TABLE 6-continued

| Reference Example No. | Compound Name | Sequence (5' to 3') | SEQ ID NO: |
|---|---|---|---|
| | R11-1 | GGGAGAAUACAAGCUACUUGUUCUUUUUGCAGCCACCAUGGACUACAAGGACGACGACGACAAGAUCAUCGACUAUAAAG(F)-p | 49 |
| | R11-2 | NH2-ACGACGACGAUAAAGGUGGCGACUAUAAGGACGACGACGACAAACACCACCACCACCACCACUGA | 50 |
| | Template DNA1 | dCdCdTdTdTdAdTdCdGdTdCdGdTdCdGdTdCdTdTdTdAdTdAdGdTdCdGdAdTdG | 4 |
| Reference Example 12 | R12 | G(M)G(M)G(M)AGAAUACAAGCUACUUGUUCUUUUUGCAGCCACC**AUG**GACUACAAGGACGACGACGACAAGAUCAUCGACUAUAAA**G/A**CGACGACGAUAAAGGUGGCGACUAUAAGGACGACGACGACAAACACCACCACCACCACCAC**U(M)G(M)A(M)** | 51 |
| | R12-1 | G(M)G(M)G(M)AGAAUACAAGCUACUUGUUCUUUUUGCAGCCACCAUGGACUACAAGGACGACGACGACAAGAUCAUCGACUAUAAAG | 52 |
| | R12-2 | pACGACGACGAUAAAGGUGGCGACUAUAAGGACGACGACGACAAACACCACCACCACCACCACU(M)G(M)A(M) | 53 |
| | Template DNA1 | dCdCdTdTdTdAdTdCdGdTdCdGdTdCdGdTdCdTdTdTdAdTdAdGdTdCdGdAdTdG | 4 |

TABLE 7

| Reference Example No. | Compound Name | Sequence (5' to 3') | SEQ ID NO: |
|---|---|---|---|
| Reference Example 13 | R13 | G(F)G(F)G(F)AGAAUACAAGCUACUUGUUCUUUUUGCAGCCACC**AUG**GACUACAAGGACGACGACGACAAGAUCAUCGACUAUAAA**G/A**CGACGACGAUAAAGGUGGCGACUAUAAGGACGACGACGACAAACACCACCACCACCACCAC**U(F)G(F)A(F)** | 54 |
| | R13-1 | G(F)G(F)G(F)AGAAUACAAGCUACUUGUUCUUUUUGCAGCCACCAUGGACUACAAGGACGACGACGACAAGAUCAUCGACUAUAAAG | 55 |
| | R13-2 | pACGACGACGAUAAAGGUGGCGACUAUAAGGACGACGACGACAAACACCACCACCACCACCACU(F)G(F)A(F) | 56 |
| | Template DNA1 | dCdCdTdTdTdAdTdCdGdTdCdGdTdCdGdTdCdTdTdTdAdTdAdGdTdCdGdAdTdG | 4 |
| Reference Example 14 | R14 | G(L)G(L)G(L)AGAAUACAAGCUACUUGUUCUUUUUGCAGCCACC**AUG**GACUACAAGGACGACGACGACAAGAUCAUCGACUAUAAA**G/A**CGACGACGAUAAAGGUGGCGACUAUAAGGACGACGACGACAAACACCACCACCACCACCAC**U(L)G(L)A(L)** | 57 |
| | R14-1 | G(L)G(L)G(L)AGAAUACAAGCUACUUGUUCUUUUUGCAGCCACCAUGGACUACAAGGACGACGACGACAAGAUCAUCGACUAUAAAG | 58 |
| | R14-2 | pACGACGACGAUAAAGGUGGCGACUAUAAGGACGACGACGACAAACACCACCACCACCACCACU(L)G(L)A(L) | 59 |
| | Template DNA1 | dCdCdTdTdTdAdTdCdGdTdCdGdTdCdGdTdCdTdTdTdAdTdAdGdTdCdGdAdTdG | 4 |
| Reference Example 15 | R15 | G(MOE)G(MOE)G(MOE)AGAAUACAAGCUACUUGUUCUUUUUGCAGCCACC**AUG**GACUACAAGGACGACGACGACAAGAUCAUCGACUAUAAA**G/A**CGACGACGAUAAAGGUGGCGACUAUAAGGACGACGACGACAAACACCACCACCACCACCAC**U(MOE)G(MOE)A(MOE)** | 60 |
| | R15-1 | G(MOE)G(MOE)G(MOE)AGAAUACAAGCUACUUGUUCUUUUUGCAGCCACCAUGGACUACAAGGACGACGACGACAAGAUCAUCGACUAUAAAG | 61 |

TABLE 7-continued

| Reference Example No. | Compound Name | Sequence (5' to 3') | SEQ ID NO: |
|---|---|---|---|
| | R15-2 | pACGACGACGAUAAAGGUGGCGACUAUAAGGACGACGACGACAAACACCACCACCACCACCACU(MOE)G(MOE)A(MOE) | 62 |
| | Template DNA1 | dCdCdTdTdTdAdTdCdGdTdCdGdTdCdGdTdCdTdTdTdAdTdAdGdTdCdGdAdTdG | 4 |

TABLE 8

| Reference Example No. | Compound Name | Sequence (5' to 3') | SEQ ID NO: |
|---|---|---|---|
| Reference Example 16 | R16 | GGGA(m6)GA(m6)A(m6)UA(m6)CA(m6)A(m6)GCUA(m6)CUUGUUCUUUUUGCA(m6)GCCA(m6)CC**A(m6)UG**GACUACAAGGACGACGACGACAAGAUCAUCGACUAUAAA**G/A**CGACGACGAUAAAGGUGGCGACUAUAAGGACGACGACGACAAACACCACCACCACCACCAC**UGA** | 63 |
| | R16-1 | GGGA(m6)GA(m6)A(m6)UA(m6)CA(m6)A(m6)GCUA(m6)CUUGUUCUUUUUGCA(m6)GCCA(m6)CCA(m6)UGGACUACAAGGACGACGACGACAAGAUCAUCGACUAUAAAG | 64 |
| | R16-2 | pACGACGACGAUAAAGGUGGCGACUAUAAGGACGACGACGACAAACACCACCACCACCACCACUGA | 65 |
| | Template DNA1 | dCdCdTdTdTdAdTdCdGdTdCdGdTdCdGdTdCdTdTdTdAdTdAdGdTdCdGdAdTdG | 4 |
| Reference Example 17 | R17 | AUUAUUAAGGAGAUAUAUCCG**AUG**AUUAUUGACUACAAG**G/A**CGACGAUGACAAAAUUAUUGACUACAAGGACGACGAUGACAA**A/C**UGCUGAUUAUUGACUACAAGGACGACGAUGACAAAAUUAUU | 66 |
| | R17-1 | AUUAUUAAGGAGAUAUAUCCGAUGAUUAUUGACUACAAGG | 67 |
| | R17-2 | pACGACGAUGACAAAAUUAUUGACUACAAGGACGACGAUGACAAA | 68 |
| | R17-3 | pCUGCUGAUUAUUGACUACAAGGACGACGAUGACAAAAUUAUU | 69 |
| | Template DNA5 | dGdTdCdAdTdCdGdTdCdGdTdCdCdTdTdGdTdAdGdTdC | 70 |
| | Template DNA6 | dCdAdAdTdAdAdTdCdAdGdCdAdGdTdTdTdGdTdCdAdTdCdG | 71 |
| Reference Example 18 | R18 | GGGAGAAUACAAGCUACUUGUUCUUUUUGCAGCCACC**AUG**GACUACAAGGACGACGACGACAAGAUCAUCGACUAUAAA**G/A**CGACGACGAUAAAGGUGGCGACUAUAAGGACGACGACGACAAACACCACCACCACCACCAC**UGA** | 72 |
| | R18-1 | GGGAGAAUACAAGCUACUUGUUCUUUUUGCAGCCACCAUGGACUACAAGGACGACGACGACAAGAUCAUCGACUAUAAAG | 73 |
| | R18-2 | pACGACGACGAUAAAGGUGGCGACUAUAAGGACGACGACGACAAACACCACCACCACCACCACUGA | 74 |
| | Template DNA1 | dCdCdTdTdTdAdTdCdGdTdCdGdTdCdGdTdCdTdTdTdAdTdAdGdTdCdGdAdTdG | 4 |

Reference Example 1

An ultrapure water solution of a 3'-amino RNA fragment R1-1 (200 μM) obtained as a sequence 15 and a 5' phosphate RNA fragment R1-2 (200 μM) obtained as a sequence 16 by chemical synthesis, and a template DNA 2 (200 μM) was heated at 90° C. for 3 minutes, and was returned to room temperature over 30 minutes or more. A separately prepared buffer solution of a condensing agent (1 M EDC-HCl/1M HOBt in 500 mM HEPES-NaOH (pH 8.5), 200 mM NACl, 200 mM $MgCl_2$) in the same volume was added to and mixed with the resultant solution to start a ligation reaction. The resultant reaction solution (nucleic acid concentration: 100 μM, 0.5 M EDC-HCl/0.5 M HOBt, 250 mM HEPES-NaOH (pH 8.5), 100 mM NaCl, 100 mM $MgCl_2$) was allowed to stand still on a temperature controlled heat block (25° C.) overnight. After the reaction, alcohol precipitation (0.3 M sodium acetate aqueous solution (pH 5.2)/70% ethanol) was performed to obtain an RNA pellet.

The thus obtained RNA was analyzed with a 7.5% modified polyacrylamide gel to calculate a reaction yield (yield: 52%).

Reference Example 2

R2-1 and R2-2 obtained by chemical synthesis, and the template DNA 1 were used in the same manner as in Reference Example 1 to calculate a generation yield (73%) of an RNA ligation product R2.

Reference Example 3

R3-1 (100 μM) and R3-2 (100 μM) obtained by chemical synthesis, and a template DNA 3 (100 μM) were used in the same manner as in Reference Example 1 to obtain an RNA ligation product R3 (7.7 nmol, yield:

Reference Example 4

R4-1 (100 μM), R4-2 (100 μM), and R4-3 (100 μM) obtained by chemical synthesis, and the template DNA 1 (100 μM) and a template DNA 4 (100 μM) were used in the same manner as in Reference Example 1 to obtain an RNA ligation product R4 (2.4 nmol, yield: 5.6%).

Reference Example 5

To R5-1 (100 μM) obtained by chemical synthesis, a phosphate buffer (50 mM) and MilliQ water were added, and a solution of iodoacetic acid NHS ester (5 mM) in DMF was further added thereto, followed by incubation at 30° C. for 2 hours. Subsequently, alcohol precipitation (0.3 M sodium acetate aqueous solution (pH 5.2)/70% ethanol) was performed to obtain a pellet of iodoacetylated R5-1. R5-2 (50 μM) obtained by chemical synthesis, the template DNA 1 (50 μM), a sodium chloride aqueous solution (100 mM), and a phosphate buffer (20 mM, pH 7.5) were mixed, and the resultant was heated at 90° C. for 3 minutes, and was returned to room temperature over 30 minutes or more. To the resultant solution, the iodoacetylated R5-1 (50 μM) was added, followed by incubation at 30° C. for 6 hours. After the reaction, alcohol precipitation (0.3 M sodium acetate aqueous solution (pH 5.2)/70% ethanol) was performed to obtain an RNA pellet. The RNA was purified with a 7.5% modified polyacrylamide gel to obtain an RNA ligation product R5 (2.32 nmol, yield: 7.3%).

Reference Example 6

R6-1 and R6-2 obtained by chemical synthesis, and the template DNA 1 were used in the same manner as in Example 1 to obtain an RNA ligation product R6 (11.1 nmol, yield: 37%).

Reference Example 7

R7-1 and R7-2 obtained by chemical synthesis, and the template DNA 1 were used in the same manner as in Example 1 to obtain an RNA ligation product R7 (3.1 nmol, yield: 10%).

Reference Example 8

R8-1 and R8-2 obtained by chemical synthesis, and the template DNA 1 were used in the same manner as in Example 1 to obtain an RNA ligation product R8 (2.6 nmol, yield: 9%).

Reference Example 9

R9-1 and R9-2 obtained by chemical synthesis, and the template DNA 1 were used in the same manner as in Example 1 to obtain an RNA ligation product R9 (5.9 nmol, yield: 20%).

Reference Example 10

R10-1 and R10-2 obtained by chemical synthesis, and the template DNA 1 were used in the same manner as in Example 1 to obtain an RNA ligation product R10 (2.1 nmol, yield: 9%).

Reference Example 11

An ultrapure water solution of an RNA fragment R11-1 (200 μM) obtained as a sequence 49 and a 5'-amino RNA fragment R11-2 (200 μM) obtained as a sequence 50 by chemical synthesis, and the template DNA 1 (200 μM) was heated at 90° C. for 3 minutes, and was returned to room temperature over 30 minutes or more. A separately prepared buffer solution of a condensing agent (1 M EDC-HCl/1M HOBt in 500 mM HEPES-NaOH (pH 8.5), 200 mM NACl, 200 mM $MgCl_2$) in the same volume was added to and mixed with the resultant solution to start a ligation reaction. The resultant reaction solution (nucleic acid concentration: 100 μM, 0.5 M EDC-HCl/0.5 M HOBt, 250 mM HEPES-NaOH (pH 8.5), 100 mM NaCl, 100 mM $MgCl_2$) was allowed to stand still on a temperature controlled heat block (25° C.) (7 hours). After the reaction, alcohol precipitation (0.3 M sodium acetate aqueous solution (pH 5.2)/70% ethanol) was performed to obtain an RNA pellet. This RNA was purified with a 7.5% modified polyacrylamide gel to obtain an RNA ligation product R11 (1.2 nmol, yield: 15%).

Reference Example 12

A 1×T4 DNA ligase buffer solution (66 mM Tris-HCl (pH 7.6), 6.6 mM $MgCl_2$, 10 mM DTT, 0.1 mM ATP) (Takara Bio Inc.) (total 2.1 mL) of R12-1 (10 μM) and R12-2 (10 μM) obtained by chemical synthesis, and the template DNA 1 (10 μM) was heated at 90° C. for 5 minutes, and was gradually cooled to room temperature. To the resultant solution, 60% PEG 6000 was added to a final concentration of 15%. T4 DNA ligase (Takara Bio Inc.) (350 units/μL)

(135 μL) was added to and mixed with the resultant solution, and the resultant was allowed to stand still on a temperature controlled heat block (25° C., 16 hours). Chloroform in the same volume was added to the resultant reaction solution, and the resultant was mixed by vortex, and was centrifuged, and then, an upper layer was taken out and subjected to alcohol precipitation (0.3 M sodium acetate aqueous solution (pH 5.2)/70% ethanol) to obtain an RNA pellet. This RNA was purified with a 7.5% polyacrylamide gel to obtain an RNA ligation product R12 (1.4 nmol, yield: 27%).

Reference Example 13

R13-1 and R13-2 obtained by chemical synthesis, and the template DNA 1 were used in the same manner as in Reference Example 12 to obtain an RNA ligation product R13 (1.3 nmol, yield: 26%).

Reference Example 14

R14-1 and R14-2 obtained by chemical synthesis, and the template DNA 1 were used in the same manner as in Example 1 to obtain an RNA ligation product R14 (9.4 nmol, yield: 31%).

Reference Example 15

R15-1 and R15-2 obtained by chemical synthesis, and the template DNA 1 were used in the same manner as in Example 1 to obtain an RNA ligation product R15 (8.6 nmol, yield: 29%).

Reference Example 16

R16-1 (10 μM) and R16-2 (10 μM) obtained by chemical synthesis, and the template DNA 1 (10 μM) were used in the same manner as in Reference Example 12 to obtain an RNA ligation product R16 (1.1 nmol, yield: 37%).

Reference Example 17

A 1×T4 DNA ligase buffer solution (66 mM Tris-HCl (pH 7.6), 6.6 mM $MgCl_2$, 10 mM DTT, 0.1 mM ATP) (Takara Bio Inc.) (total 2.1 mL) of R17-1 (50 μM) and R17-2 (50 μM) obtained by chemical synthesis, and a template DNA 5 (100 μM) was heated at 90° C. for 5 minutes, and was gradually cooled to room temperature. To the resultant solution, 50% PEG 6000 was added to a final concentration of 10%. T4 DNA ligase (Takara Bio Inc.) (350 units/μL) (135 μL) was added to and mixed with the resultant solution, and the resultant was allowed to stand still on a temperature controlled heat block (25° C., 16 hours). Chloroform in the same volume was added to the resultant reaction solution, and the resultant was mixed by vortex, and was centrifuged, and then, an upper layer was taken out and subjected to alcohol precipitation (0.3 M sodium acetate aqueous solution (pH 5.2)/70% ethanol) to obtain an RNA pellet. This RNA was purified with a 7.5% polyacrylamide gel to obtain an RNA ligation product L84 (P-0) (30 nmol, yield: 22%).

A 1×T4 DNA ligase buffer solution (66 mM Tris-HCl (pH 7.6), 6.6 mM $MgCl_2$, 10 mM DTT, 0.1 mM ATP) (Takara Bio Inc.) (total 80 μL) of L84 (P-0) (50 μM, 20 μL) and R17-3 (160 μM, 12.5 μL), and a template DNA 6 (160 μM, 12.5 μL) was heated at 90° C. for 5 minutes, and gradually cooled to room temperature. To the resultant solution, 50% PEG 6000 was added to a final concentration of 10%. T4 DNA ligase (Takara Bio Inc.) (350 units/μL) (5 μL) was added to and mixed with the resultant solution, and the resultant was allowed to stand still on a temperature controlled heat block (25° C., 16 hours). Chloroform in the same volume was added to the resultant reaction solution, and the resultant was mixed by vortex, and was centrifuged, and then, an upper layer was taken out and subjected to alcohol precipitation (0.3 M sodium acetate aqueous solution (pH 5.2)/70% ethanol) to obtain an RNA pellet. This RNA was purified with a 7.5% polyacrylamide gel to obtain an RNA ligation product R17 (360 pmol, yield: 36%).

Reference Example 18

R18-1 and R18-2 obtained by chemical synthesis, and the template DNA 1 were used in the same manner as in Example 1 to obtain an RNA ligation product R18 (11.9 nmol, yield: 40%).

Test Example 1

(Translation Reaction of mRNA Sample)

A translation reaction was performed with a commercially available translation kit in accordance with product protocol. A translation reaction in a prokaryotic cell system was performed with the compound R1 and the compound R17 used as substrate RNAs, and with PURExpress® (New England BioLabs, Inc.) used as a reagent.

A translation reaction in a eukaryotic cell system was performed with the compound R2 and the compound R18 used as substrate RNAs, and with Rabbit Reticulocyte Lysate System, Nuclease Treated (hereinafter referred to as RRL) (Promega Corp.) used as a reagent.

(Sample Preparation in Translation Reaction)

A sample was prepared in accordance with recommended protocol of each kit. A reaction solution containing materials except for RNAs used as substrates was used as a translation reaction solution. The translation reaction solution was added for mixing to a tube holding an RNA sample having been dried and hardened with a centrifugal evaporator, and the resultant was placed on a heat block at a suitable temperature to start the translation reaction. A translation product was detected by Western blotting using an anti-FLAG antibody. As a primary antibody, an anti-FLAG antibody (F1804, Sigma) was used, and as a secondary antibody, an anti-mouse IgG antibody (anti-mouse IgG-HRP) (A9044, Sigma) was used.

(Translation Reaction in Prokaryotic Cell System)

A mixture of Solution A (2 μL) and Solution B (1.5 μL) attached to a PURExpress® kit, an RNase inhibitor (Murine RNase Inhibitor, New England BioLabs, Inc.) (0.1 μL), and ultrapure water (1.4 μL) was used as a translation reaction solution. This solution was added for mixing to a tube holding an RNA sample to perform a translation reaction (37° C., 2 hours).

(Translation Reaction in Eukaryotic Cell System)

A mixture of Rabbit Reticulocyte Lysate (14.0 μL) attached to Rabbit Reticulocyte Lysate System kit, Amino Acid Mixture-Met (0.20 μL), Amino Acid Mixture-Leu (0.20 μL), Murine RNase inhibitor (New England BioLabs, Inc.) (0.4 μL), and ultrapure water (5.2 μL) was used as a translation reaction solution. This solution was added for mixing to a tube holding an RNA sample to perform a translation reaction (30° C., 2 hours).

(SDS-PAGE Analysis of Translation Product)

In SDS-PAGE, a discontinuous buffer system was used. The composition of a used gel was as follows: For an upper layer, 5% polyacrylamide (acrylamide:bisacrylamide=29:1)

(0.125 M Tris-HCl (pH 6.8), 0.1% SDS) was used as a concentrated gel region (about 1.5 cm), and for a lower layer, 15% polyacrylamide (acrylamide:bisacrylamide=29:1) (0.375 M Tris-Hcl (pH 8.8), 0.1% SDS) was used as a separating gel region, an APS aqueous solution and TEMED were added as a polymerizing agent, and the resultant was solidified (room temperature, 30 minutes) to produce a gel. A reaction solution of the translation reaction was mixed with a 2×SDS-PAGE loading buffer (125 mM Tris-HCl (pH 6.8), 30 (v/v) % glycerol, 4% sodium dodecylsulfate (hereinafter referred to as SDS), 0.03% bromophenol blue (hereinafter referred to as BPB)), the resultant was heated at 90° C. for 3 minutes, and the resultant was used as a sample of SDS-PAGE analysis. The sample of SDS-PAGE analysis was immediately subjected to electrophoresis (using 25 mM Tris, 192 mM glycine, and 0.1% SDS as a buffer for electrophoresis) in the SDS-PAGE gel.

(Detection of Translation Product by Western Blotting)

After the electrophoresis, the translation product on the gel was transcribed, by a semi-dry method, onto a Western blotting membrane (Immobilon®-P) (IPVH00010, Millipore Corp.) (which membrane had been hydrophilized with methanol as a pretreatment, and immersed in a blotting buffer (25 mM Tris, 192 mM glycine, 20% MeOH)). In the transcription, a constant current condition (current applying time: 1 hour) was employed, and a current value to be employed was determined in accordance with the size of the membrane. Specifically, a current value (mA) was set to the membrane area ($cm^2$)×2.

Figure 4:
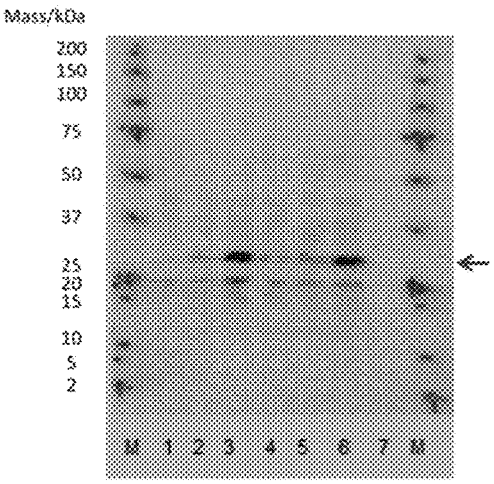
FIG. 4 illustrates Western blot analysis results of a translation reaction performed with PURExpress® with a compound R1 and a compound R17 used as substrates. Respective lanes are: (1-3: Compound R17) (concentrations in a reaction solution: 1, 3 and 5 μM), 4-6: Compound R1 (concentrations in a reaction solution: 1, 3, and 5 μM), 7: no RNA, M: protein size marker (Precision Plus Protein Dual Extra Standards (BIORAD))). Each numerical value shown on the left hand side in the drawing indicates a molecular weight of a protein, and an arrow indicates a generated translation product.
Figure 5:
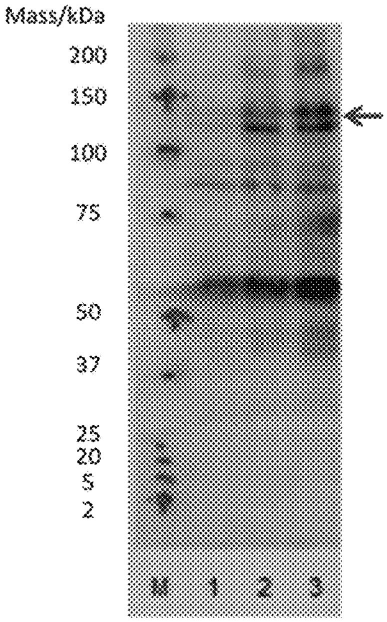
FIG. 5 illustrates Western blot analysis results of a translation reaction performed with RRL with a compound R2 and a compound R18 used as substrates. Respective lanes are: (1: no RNA, 2: Compound R18 (5 μg), 3: Compound R2 (5 μg), M: protein size marker (Precision Plus Protein Dual Extra Standards (BIORAD))). Each numerical value shown on the left hand side in the drawing indicates a molecular weight of a protein, and an arrow indicates a generated translation product.

A TBS-T solution of 5% ECL Prime used in a subsequent operation was prepared by mixing Amersham ECL Prime (GE Healthcare Ltd.) and TBS-T (0.05 M Tris-HCl (pH 7.4), 150 mM NaCl, 0.05% tween 20). The membrane onto which the translation product had been transcribed was subjected to a blocking treatment (TBS-T solution of 5% ECL Prime, room temperature, shaking for 1 hour), and then subjected to a primary antibody treatment (diluted 4,000 fold, TBS-T solution of 0.5% ECL Prime, 4° C., shaking for 12 hours), washing (TBS-T, 5 minutes×shaking five times), a secondary antibody treatment (diluted 50,000 fold, TBS-T solution of 0.5% ECL Prime, room temperature, shaking for 1 hour), and washing (TBS-T, 5 minutes×five times). After the antibody treatment, the translation product on the membrane was detected by using a chemiluminescent reagent (SuperSignal West Femto Maximum Sensitivity Substrate (Thermo Scientific) in accordance with recommended protocol of the product. After the treatment with the chemiluminescent reagent, a signal of the translation product was detected with ChemiDoc (BIORAD) (detection mode: chemiluminescence, exposure time: 90 to 300 seconds). Results are illustrated in FIG. 4 and FIG. 5.

It is understood, based on the Western blot analysis results of the translation reaction product obtained with PURExpress® with the compound R1 and the compound R17 used as substrates and the Western blot analysis of the translation reaction product obtained with RRL with the compound R2 and the compound R18 used as substrates, that the amount of the translation product obtained from the compound R1 and the compound R2 containing a non-natural type linking portion is comparable to the amount of the translation product obtained from the compound R17 and the compound R18 of natural type in the prokaryotic system and the eukaryotic system.

Test Example 2

(Translation Reaction in Eukaryotic Cell System: Translation Reaction Test with Rabbit Erythrocyte Lysate)

The respective compounds obtained in Examples 1 to 3 and Reference Examples 6 to 10, 14, 15, and 18 were evaluated for translation activity in the eukaryotic cell system with Rabbit-Reticulocyte-Lysate-System-Nuclease-Treated Kit (Promega Corp., Catalog No. L4960). First, each mRNA sample obtained by diluting each of the compounds to a final concentration of 0.3 μM with THE RNA storage solution (Thermo Fisher Scientific K.K., Catalog No. AM7001) was dispensed into a 96 well PCR plate (manufactured by As One Corporation) by 2 μL each. Subsequently, a master mix was prepared by mixing 7.0 μL per reaction of Reticulocyte Lysate, Nuclease Treated, 0.1 μL per reaction of Amino Acid Mixture Minus Leucine, 0.1 μL per reaction of Amino Acid Mixture Minus Methionine, 0.4 μL per reaction of RNase Inhibitor, Murine (manufactured by New England BioLabs, Inc., Catalog No. M0314), and 0.4 μL per reaction of purified water, and the resultant was dispensed by 8 μL each into the PCR plate to which the mRNA sample had been added, and after addition and mixture, the resultant was allowed to stand still at 37° C. for 1 hour to perform a translation reaction.

A translation product in a reaction solution obtained after the translation reaction was detected by the following sandwich ELISA method: First, 6*His, His-Tag antibody (Proteintech Group, Inc., Catalog No. 66005-1-Ig) was diluted with 0.1 M carbonate buffer (pH 9.4) to 3 μg/mL, and the resultant was dispensed into a 96 well ELISA plate (manufactured by Nunc Inc.) by 50 μL per well, and was allowed to stand still at 4° C. overnight, and thus, a plate in which the antibody was immobilized was produced. Subsequently, the plate was washed with Tris Buffered Saline with Tween 20 (Santa Cruz Biotechnology, Catalog No. sc-24953) diluted 1× concentration with purified water (hereinafter referred to as the washing solution), and then, a washing solution obtained by diluting bovine serum albumin (Wako Pure Chemical Industries Ltd., Catalog No. 017-22231) to a final concentration of 3% (hereinafter referred to as the blocking solution) was dispensed thereinto by 200 μL per well, and the resultant was allowed to stand still at room temperature for 1 hour. After washing the plate with the washing solution, the translation reaction solution diluted 100 fold with the blocking solution was dispensed thereinto by 50 μL per well, and the resultant was allowed to stand still at room temperature for 1 hour. At this point, a translation product polypeptide preparation (manufactured by Scrum Inc.) was similarly diluted to each concentration with the blocking solution to be dispensed into the plate. After washing the plate with the washing solution, Monoclonal ANTI-FLAG M2-Peroxidase (HRP) Ab produced in mouse (manufactured by SIGMA, Catalog Antibody A8592-1MG) diluted 10,000 fold with the blocking solution was dispensed thereinto by 50 μL per well, and the resultant was allowed to stand still at room temperature for 1 hour. After washing the plate with the washing solution, 1-Step Ultra TMB-ELISA (Thermo Fisher Scientific K.K., Catalog No. 34028) was dispensed thereinto by 50 μL per well, and the resultant was allowed to stand still at room temperature for several minutes. Thereafter, 0.5 M sulfuric acid (manufactured by Wako Pure Chemical Industries Ltd.) was dispensed thereinto by 50 μL per well to stop the reaction, and then, absorbances at a measurement wavelength of 450 nm and a reference wavelength of 570 nm were measured with an absorptiometer (manufactured by BIORAD). Tables 9 to 11 show a translation product concentration (μM) in each translation reaction solution quantitatively determined with a calibration curve created based on the absorbances of the polypeptide preparation, and a relative amount of the translation product calculated assuming that the amount obtained from R18 having no sugar modification is 1.

TABLE 9

Concentration of Translation Product obtained from Compound and Relative Amount of Translation Product

| Compound Name | SEQ ID NO: | Translation Product Concentration (μM) | Relative Amount of Translation Product |
|---|---|---|---|
| E1 | 1 | 2.83 | 0.83 |
| R10 | 45 | 0.03 | 0.01 |
| R18 | 72 | 3.41 | 1 |

TABLE 10

Concentration of Translation Product obtained from Compound and Relative Amount of Translation Product

| Compound Name | SEQ ID NO: | Translation Product Concentration (μM) | Relative Amount of Translation Product |
|---|---|---|---|
| E2 | 5 | 16.53 | 3.22 |
| E3 | 8 | 12.37 | 2.41 |
| R6 | 33 | 9.63 | 1.88 |
| R14 | 57 | 12.31 | 2.40 |
| R15 | 60 | 25.45 | 4.96 |
| R18 | 72 | 5.13 | 1 |

TABLE 11

Concentration of Translation Product obtained from Compound and Relative Amount of Translation Product

| Compound Name | SEQ ID NO: | Translation Product Concentration (μM) | Relative Amount of Translation Product |
|---|---|---|---|
| R7 | 36 | 10.45 | 2.94 |
| R8 | 39 | 6.79 | 1.91 |
| R9 | 42 | 7.87 | 2.21 |
| R18 | 72 | 3.56 | 1 |

As is obvious from Tables 9 to 11, each compound produced, after being added to the rabbit erythrocyte lysate, a polypeptide encoded by a gene sequence in the eukaryotic cell translation system.

(Translation Reaction Test of mRNA Sample with Hela Cell Lysate)

The respective compounds obtained in Examples 1 to 4 and Reference Examples 6, 10, 14, 15, and 18 were evaluated for translation activity in a human cell system with 1-Step Human Coupled IVT Kit (manufactured by Thermo Fisher Scientific K.K., Catalog No. 88882). First, each compound diluted to a final concentration of 0.3 μM with THE RNA storage solution (Thermo Fisher Scientific K.K., Catalog No. AM7001) was dispensed into a 96 well PCR plate (manufactured by As One Corporation) by 1 μL each. Subsequently, a master mix was prepared by mixing 5.0 μL per reaction of Hela Lysate, 1.0 μL per reaction of Accessory Proteins, 2.0 μL per reaction of Reaction Mix, 0.2 μL per reaction of RNase Inhibitor, Murine (manufactured by New England BioLabs, Inc., Catalog No. M0314), and 0.8 μL per reaction of purified water, and the resultant was dispensed by 9 μL each into the PCR plate to which the mRNA sample had been added, and after addition and mixture, the resultant was allowed to stand still at 37° C. for 45 minutes to perform a translation reaction.

A translation product in a reaction solution obtained after the translation reaction was detected by the sandwich ELISA method described in Test Example 2 (Translation Reaction in Eukaryotic Cell System: Translation Reaction Test with Rabbit Erythrocyte Lysate) in the same manner except that the translation reaction solution was diluted 20 fold with the blocking solution and added to the plate. As results of the measurement, Tables 12 to 14 show a translation product concentration (μM) in each translation reaction solution quantitatively determined with a calibration curve created based on the absorbances of the polypeptide preparation, and a relative amount of the translation product calculated assuming that the amount obtained from R18 having no sugar modification is 1.

TABLE 12

Concentration of Translation Product obtained from Compound and Relative Amount of Translation Product

| Compound Name | SEQ ID NO: | Translation Product Concentration (μM) | Relative Amount of Translation Product |
|---|---|---|---|
| E1 | 1 | 0.066 | 0.60 |
| R10 | 45 | 0.008 | 0.07 |
| R18 | 72 | 0.111 | 1 |

TABLE 13

Concentration of Translation Product obtained from Compound and Relative Amount of Translation Product

| Compound Name | SEQ ID NO: | Translation Product Concentration (μM) | Relative Amount of Translation Product |
|---|---|---|---|
| E2 | 5 | 1.532 | 3.35 |
| E3 | 8 | 1.809 | 3.96 |
| R6 | 33 | 1.413 | 3.09 |
| R14 | 57 | 0.231 | 0.50 |
| R15 | 60 | 2.777 | 6.07 |
| R18 | 72 | 0.457 | 1 |

TABLE 14

Concentration of Translation Product obtained from Compound and Relative Amount of Translation Product

| Compound Name | SEQ ID NO: | Translation Product Concentration (μM) | Relative Amount of Translation Product |
|---|---|---|---|
| E4 | 11 | 2.37 | 3.82 |
| R18 | 72 | 0.62 | 1 |

As is obvious from Tables 12 to 14, each compound produced, after being added to the Hela cell lysate, a polypeptide encoded by a gene sequence in the human cell translation system.

(In Vitro Translation Reaction Test of mRNA Sample with Hela Cell Line)

The respective compounds obtained in Examples 2 and 3 and Reference Examples 6 and 15 were evaluated for translation activity in vitro with Hela cell line. First, a Hela cell suspended in RPMI medium (manufactured by Nacalai Tesque, Inc.) containing 10% fetal bovine serum was seeded in a 96 well adherent cell culture plate at 10,000 cells/100 μL per well, and the resultant was cultured at 37° C. under 5% CO2 condition overnight. A culture supernatant was removed from the cell cultured overnight, RPMI medium containing 40 μL of 10% fetal bovine serum per well was added thereto, and each compound and Lipofectamin Messenger MAX Transfection Reagent (manufactured by Thermo Fisher Scientific K.K., Catalog No: LMRNA008) were diluted and mixed with Opti-MEM (manufactured by Thermo Fisher Scientific K.K., Catalog No: 31985-070) to a final concentration of each compound of 0.3 μM, the resultant mixture was added to each culture plate in an amount of 10 μL per well, and the resultant was cultured at 37° C. under 5% CO2 condition for 6 hours. A culture supernatant was removed from the cell cultured for 6 hours, the resultant was washed once with ice cooled D-PBS(−) (manufactured by Nacalai Tesque, Inc.), NP-40 (Invitrogen Corp., FNN0021) containing 2% protease inhibitor cocktail (for an animal cell extract) was added thereto in an amount of 20 μL per well, and the resultant was vigorously shaken for 5 minutes for cell lysis.

A translation product in a cell lysate thus obtained was detected by the sandwich ELISA method described in Test Example 2 (Translation Reaction in Eukaryotic Cell System: Translation Reaction Test with Rabbit Erythrocyte Lysate) in the same manner except that the cell lysate was diluted 10 fold with the blocking solution and added to the plate. As results of the measurement, Table 15 shows a translation product concentration (nM) in each translation reaction solution quantitatively determined with a calibration curve created based on the absorbances of the polypeptide preparation, and a relative amount of the translation product calculated assuming that the amount obtained from R6 having no sugar modification is 1.

TABLE 15

Concentration of Translation Product obtained from Compound and Relative Amount of Translation Product

| Compound Name | SEQ ID NO: | Translation Product Concentration (nM) | Relative Amount of Translation Product |
|---|---|---|---|
| E2 | 5 | 25.86 | 2.94 |
| E3 | 8 | 20.59 | 2.34 |
| R6 | 33 | 8.79 | 1 |
| R15 | 60 | 29.30 | 3.33 |

As is obvious from Table 15, each compound produced, after being added to the Hela cell, a polypeptide encoded by a gene sequence.

Test Example 3

(Stability Test of Each Compound with Phosphodiesterase I)

The respective compounds (RNA solutions) produced in Example 1 and Reference Examples 10 and 18 were used to evaluate stability against phosphodiesterase I (SVPD) by the following method: 10 μL of MQ water, 4 μL of the 5 μM RNA solution, 4 μL of a 5× reaction buffer (Tris-HCl pH 8.0 0.1M, NaCl 0.5 M, $MgCl_2$ 0.075 M), and 4 μL of 5.5 U/μL of SVPD (Warthington, Catalog No. 3926) were added, followed by incubation at 37° C. The resultant solution was sampled in an amount of 6 μL each at timing of 15, 30 and 60 minutes after starting the reaction.

(Evaluation of RNA Degradation by PAGE)

The whole amount of each sample thus sampled was applied to 5% dPAGE (5% acrylamide, 7M urea, small gel, 8 cm×8 cm), and subjected to electrophoresis at 300 V constant voltage for 18 minutes. The resultant was stained with SYBR Green II, and photographed and quantitatively determined. An amount of each compound remaining in each sample was calculated as a remaining amount relative to the amount before the enzymatic reaction (0 min), which is shown in Table 16.

TABLE 16

Remaining Amount of Compound Relative to Amount before Enzymatic Reaction (0 min) at Each Reaction Time

| Compound Name | SEQ ID NO: | 0 min | 15 min | 30 min | 60 min |
|---|---|---|---|---|---|
| E1 | 1 | 1 | 0.18 | 0.04 | 0.00 |
| R10 | 45 | 1 | 0.55 | 0.44 | 0.35 |
| R18 | 72 | 1 | 0.03 | 0.00 | 0.00 |

As is obvious from Table 16, a compound having sugar modification was improved in resistance against phosphodiesterase I as compared with the compound R18 having no sugar modification.

Test Example 4

(Stability Test of mRNA Sample with Phosphodiesterase I)

The respective compounds obtained in Examples 1 to 4 and Reference Examples 6, 14, 15, and 18 were used to evaluate enzyme stability with phosphodiesterase I (Warthington, Catalog No. 3926). First, phosphodiesterase I was prepared to a final concentration of 55 U/mL with SVPD stock solution (110 mM Tris-HCl (Nippon Gene Co., Ltd., Catalog No. 314-90401), 110 mM NaCl (Ambion, Inc., Catalog No. AM9759), 15 mM $MgCl_2$ (Nacalai Tesque, Inc., Catalog No. 20942-34)), and the resultant was further diluted 10 fold with 5×SVPD reaction buffer (100 mM Tris-HCl (Ambion, Inc., Catalog No. AM9855G), 500 mM NaCl, 75 mM $MgCl_2$) to prepare a 5.5 U/mL SVPD enzyme solution. Each compound was diluted to a final concentration of 5 μM with THE RNA storage solution (Thermo Fisher Scientific K.K., Catalog No. AM7001).

To a 96 well PCR plate, 30 μL of distilled water, 12 μL of 5 μM mRNA, and 12 μL of 5×SVPD reaction buffer were successively added to produce an enzymatic reaction premix solution. As a sample before the enzymatic reaction (0 min), 9 μL of the enzymatic reaction premix solution was dispensed into another 96 well PCR plate, 3.5 μL of a mixed solution of 1 μL of the SVPD solution and 2.5 μL of 25 mM EDTA (Ambion, Inc., Catalog No. AM9260G) was added thereto, and the resultant was stored at −30° C. As a sample for the enzymatic reaction, 40.5 μL of the enzymatic reaction premix solution was dispensed into still another 96 well PCR plate, and 4.5 μL of 5.5 U/mL SVPD enzymatic solution was added thereto to be well mixed. The resultant was dispensed into each of four fresh 96 well PCR plates by 10 μL each, a reaction was caused in the respective plates at 37° C. respectively for prescribed times (15 min, 30 min, and 60 min), 2.5 μL of 25 mM EDTA was added thereto, and the resultant was stored at −30° C. until measurement.

A remaining amount of mRNA in the reaction solution after the enzymatic reaction was detected by RT-qPCR method as follows: First, for a calibration curve, a compound E4 was used to make dilution series by obtaining 11 concentrations from 4 μM with 4-fold dilution with THE RNA storage solution. 2.5 μL of each of samples for the calibration curve and after the enzymatic reaction was diluted 1071 fold by using distilled water to which Ribonuclease Inhibitor (Takara Bio Inc., Catalog No. 2311B) had been added to a final concentration of 0.2 U/mL. A reverse transcription product cDNA was produced using 5 μL of the diluted sample and 2 μL of 2 μM RT primer (Sigma Aldrich Co.) with an iScript Select cDNA Synthesis Kit (BIO-RAD, Catalog No. 1708897). The reaction was performed at a reaction temperature of 25° C. for 5 minutes, then at 42° C.

for 30 minutes, and then at 85° C. for 5 minutes. 2 μL of cDNA, 10 μL of TaqMan Gene Expression Master Mix, 0.28 μL of Fw primer (Sigma Aldrich Co.), 0.33 μL of Rv primer (Sigma Aldrich Co.), 0.38 μL of TaqMan MGB Probe (Thermo Fisher Scientific K.K., Catalog No. 4316033), and 7.01 μL of distilled water were mixed to perform qPCR measurement. As an apparatus, Quantstudio12K Flex (Applied Biosystems) was used. The DNA sequences of the used primers and Taqman MGB probe were as follows. As results of the measurement, a concentration of each compound in each sample was quantitatively determined by using a calibration curve based on a CT value of a preparation, and a relative remaining amount with respect to the amount before the enzymatic reaction (0 min) was calculated, which is shown in Table 17.

```
RT primer:
                                    (SEQ ID NO: 75)
5'-TCAGTGGTGGTGGTGGTGGTGTTTG-3'

Fw primer:
                                    (SEQ ID NO: 76)
5'-ATCTTGTCGTCGTCGTCCTT-3'

Rv primer:
                                    (SEQ ID NO: 77)
5'-GAATACAAGCTACTTGTTCTTTT-3'

Taqman MGB Probe:
                                    (SEQ ID NO: 78)
5'-CAGCCACCATG-3'
```

TABLE 17

Remaining Amount of Compound Relative to Amount before Enzymatic Reaction (0 min) at Each Reaction Time

| Compound Name | SEQ ID NO: | 0 min | 15 min | 30 min | 60 min |
|---|---|---|---|---|---|
| E1 | 1 | 1 | 0.329 | 0.091 | 0.010 |
| E2 | 5 | 1 | 0.542 | 0.277 | 0.101 |
| E3 | 8 | 1 | 0.517 | 0.273 | 0.040 |
| E4 | 11 | 1 | 0.475 | 0.134 | 0.016 |
| R6 | 33 | 1 | 0.341 | 0.161 | 0.009 |
| R14 | 57 | 1 | 0.474 | 0.207 | 0.018 |
| R15 | 60 | 1 | 0.399 | 0.123 | 0.010 |
| R18 | 72 | 1 | 0.239 | 0.045 | 0.002 |

As is obvious from Table 17, E1, E4, R14 and R15 having sugar modification were improved in the resistance to phosphodiesterase I as compared with the compound R18 having no sugar modification.

Similarly, E2 and E3 having sugar modification was improved in the resistance to phosphodiesterase I as compared with the compound R6 having no sugar modification.

Test Example 5

(Translation Reaction in Eukaryotic Cell System)

The respective compounds (RNAs) obtained in Reference Examples 3 to 5, 11 to 13, 16 and 18 were evaluated for the translation reaction in a eukaryotic cell system by the following method. A solution contained in Rabbit-Reticulocyte-Lysate System-Nuclease-Treated (Promega L4960), RNase inhibitor Murine (New England Biolabs Inc., M0314S) and the RNA were mixed in the following composition: RRL 7.0 μL, 1 mM AA-Leu 0.1 μL, 1 mM AA-Met 0.1 μL, Rnase Inhibitor 0.4 μL, RNA 5 μM 2.0 μL, and MQ 0.4 μL. The resultant solution was incubated at 37° C. for 1 hour. After the incubation, 5 μL of the resultant solution was taken out, and was diluted 100 fold with 495 μL of Blocking buffer (3% BSA/TBST). 100 μL of the thus diluted translation solution was used in ELISA.

(Detection of Translation Product by Sandwich ELISA)

To a 96 well plate, 100 μL/well of Anti-Histag solution (Proteintech Group, Inc., Catalog No. 66005-1-Ig) (3 μg/mL in 0.1 M Carbonate buffer pH 9.4) was added. The resultant was covered with a parafilm, and was incubated at 4° C. for 12 hours. A solution held in the plate was discarded, and the plate was washed with 200 μL/well of TBST three times. To the resultant plate, 200 μL/well of Blocking buffer (3% BSA/TBST) was added, followed by incubation at room temperature for 1 hour. A solution held in the plate was discarded, and the plate was washed with 200 μL/well of TBST three times. To the resultant, 100 μL/well of a translation reaction solution was added, followed by incubation at room temperature for 1 hour. The translation reaction solution held in the plate was discarded, and the plate was washed with 200 μL/well of TBST three times. To the resultant, 100 μL/well of an anti-Flag solution (Cell Signaling Technology, Inc., Catalog No. 2368) (1:1000 in blocking buffer) was added. The resultant was covered with a parafilm so as not to be dried and concentrated, and was incubated at 4° C. overnight. The solution held in the plate was discarded, and the plate was washed with 200 μL/well of TBST three times. To the resultant, 100 μL/well of an anti-rabbit IgG HRP solution (Sigma Aldrich Co.) (1:10000 in blocking buffer) was added, followed by incubation at room temperature for 1 hour. The solution held in the plate was discarded, and the plate was washed with 200 μL/well of TBST four times. To the resultant, 100 μL/well of a TMB substrate solution was added, followed by incubation at room temperature for 5 minutes. To the wells where the TBM substrate solution had been added, 100 μL/well of a 2M $H_2SO_4$ solution was added. A plate reader (Mithras LB940 (Berthold)) was used to measure an absorbance at 450 nm for evaluating translation efficiency. As results of the measurement, quantitative determination was performed by using a calibration curve created based on an absorbance of a polypeptide preparation, and Tables 18 to 20 show a translation product concentration (μM) in each translation reaction solution, and a relative amount of the translation product calculated assuming that the amount obtained from R18 having no sugar modification is 1.

TABLE 18

Concentration of Translation Product obtained from Compound

| Compound Name | SEQ ID NO: | Translation Product Concentration (μM) | Relative Amount of Translation Product |
|---|---|---|---|
| R3 | 21 | 4.14 | 1.18 |
| R4 | 25 | 2.65 | 0.75 |
| R5 | 30 | 4.01 | 1.14 |
| R11 | 48 | 2.24 | 0.64 |
| R18 | 72 | 3.52 | 1 |

TABLE 19

Concentration of Translation Product obtained from Compound

| Compound Name | SEQ ID NO: | Translation Product Concentration (μM) | Relative Amount of Translation Product |
|---|---|---|---|
| R12 | 51 | 7.63 | 2.17 |
| R13 | 54 | 7.90 | 2.25 |
| R18 | 72 | 3.52 | 1 |

TABLE 20

| Concentration of mRNA Translation Product | | | |
|---|---|---|---|
| Compound Name | SEQ ID NO: | Translation Product Concentration (μM) | Relative Amount of Translation Product |
| R16 | 63 | 8.97 | 3.29 |
| R18 | 72 | 2.73 | 1 |

As is obvious from Tables 18 to 20, each compound produced, after being added to the rabbit erythrocyte lysate, a polypeptide encoded by a gene sequence in the eukaryotic cell translation system.

Sequence information of the compounds (polynucleotides) of Examples is as follows.

Each nucleotide N (upper case) in tables indicates an RNA, each nucleotide n (lower case) indicates a DNA, N(M) indicates a 2'-O-methyl modified RNA, N(F) indicates a 2'-F modified RNA, N(L) indicates an LNA, and N(MOE) indicates a 2'-O-methoxyethyl modified RNA. Am6 indicates that a base portion is N6-methyladenine, and Ae6 indicates that a base portion is N6-ethyladenine. Besides, p indicates that the 3' or 5' end is phosphorylated. A sign ^ indicates that a phosphate group linking between sugar portions is phosphorothioate. N(B) indicates 2',4'-BNA$^{NC}$ (Me) containing the following sugar portion:

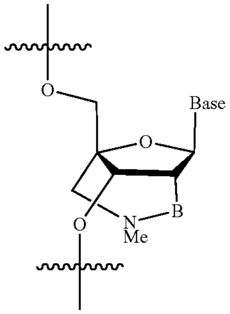

BDBD indicates an artificial dangling end having the following structure:

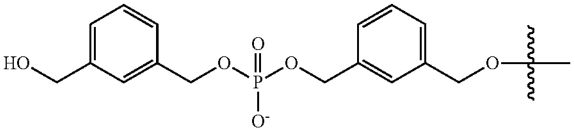 [SMILES: *OCc1cccc(COP(=O)([O-])OCc2cccc(CO)c2)c1]

TABLE 21

| Compound Name | Synthesis Method | Sequence (5' to 3') | SEQ ID NO: |
|---|---|---|---|
| E5 | Same as Example 1 | GGGAGCCACCAUGGACUACAAGGACGACGACGACAAGAUCAUCGACUAUA AAGACGACGACGAUAAAGGUGGCGACUAUAAGGACGACGACGACAAAGCC AUUAAUAGUGACUCUGAGUGUCCCCUGUCCCACGACGGGUACUGCCUCCA CGACGGUGUGUGCAUGUAUAUUGAAGCAUUGGACAAGUACGCCUGCAACU GUGUUGUUGGCUACAUCGGGGAGCGCUGUCAGUACCGAGACCUGAAGUGG UGGGAACUGCGCCU | 79 |
| E5-1 | Solid Phase Synthesis | GGGAGCCACCAUGGACUACAAGGACGACGACGACAAGAUCAUCGACUAUA AAGACGACGACGAUAAAGGUGGCGACUAUAAGGACGACGACGAC | 80 |
| E5-2 | Solid Phase Synthesis | pAAAGCCAUUAAUAGUGACUCUGAGUGUCCCCUGUCCCACGACGGGUACU GCCUCCACGACGGUGUGUGCAUGUAUAUUGAAGCAU | 81 |
| E5-3 | Solid Phase Synthesis | pUGGACAAGUACGCCUGCAACUGUGUUGUUGGCUACAUCGGGGAGCGCUG UCAGUACCGAGACCUGAAGUGGUGGGAACUGCGCCU | 82 |
| E6 | Same as Example 1 | GGGAGAAUACAAGCUACUUGUUCUUUUUGCAGCCACCAUGGACUACAAGG ACGACGACGACAAGAUCAUCGACUAUAAAGACGACGACGAUAAAGGUGGC GACUAUAAGGACGACGACGACAAAAGUAUAAUAAACUUUGAAAAACUGCA CCACCACCACCACCACUGA | 83 |
| E6-1 | Solid Phase Synthesis | GGGAGAAUACAAGCUACUUGUUCUUUUUGCAGCCACCAUGGACUACAAGG ACGACGACGACAAGAUCAUCGACUAUAAAGACGACGACG | 84 |
| E6-2 | Solid Phase Synthesis | pAUAAAGGUGGCGACUAUAAGGACGACGACGACAAAAGUAUAAUAAACUU UGAAAAACUGCACCACCACCACCACCACUGA | 85 |
| E7 | Same as Reference Example 1 | GG(F)GAG(F)AAU(F)ACA(F)AGC(F)UAC(F)UUG(F)UUC(F)UUU (F)UUG(F)CAG(F)CCA(F)CCA(F)UGG(F)ACU(F)ACA(F)AGG(F) ACG(F)ACG(F)ACG(F)ACA(F)AGA(F)UCA(F)UCG(F)ACU(F)AU A(F)AAG(amino)ACG(F)ACG(F)ACG(F)AUA(F)AAG(F)GUG(F) GCG(F)ACU(F)AUA(F)AGG(F)ACG(F)ACG(F)ACG(F)ACA(F)AA C(F)ACC(F)ACC(F)ACC(F)ACC(F)ACC(F)ACU(F)GA | 86 |
| E7-1 | Solid Phase Synthesis | GG(F)GAG(F)AAU(F)ACA(F)AGC(F)UAC(F)UUG(F)UUC(F)UUU (F)UUG(F)CAG(F)CCA(F)CCA(F)UGG(F)ACU(F)ACA(F)AGG(F) ACG(F)ACG(F)ACG(F)ACA(F)AGA(F)UCA(F)UCG(F)ACU(F)AU A(F)AAG(amino) | 87 |
| E7-2 | Solid Phase Synthesis | pACG(F)ACG(F)ACG(F)AUA(F)AAG(F)GUG(F)GCG(F)ACU(F)A UA(F)AGG(F)ACG(F)ACG(F)ACG(F)ACA(F)AAC(F)ACC(F)ACC (F)ACC(F)ACC(F)ACC(F)ACU(F)GA | 88 |

TABLE 21-continued

| Compound Name | Synthesis Method | Sequence (5' to 3') | SEQ ID NO: |
|---|---|---|---|
| E8 | Same as Reference Example 1 | G(M)G(M)G(M)A(M)G(M)A(M)AUACAAGCUACUUGUUCUUUUUGCAG CCACCAUGG(F)ACU(F)ACA(F)AGG(F)ACG(F)ACG(F)ACG(F)AC A(F)AGA(F)UCA(F)UCG(F)ACU(F)AUA(F)AAG(amino)ACG(F) ACG(F)ACG(F)AUA(F)AAG(F)GUG(F)GCG(F)ACU(F)AUA(F)AG G(F)ACG(F)ACG(F)ACG(F)ACA(F)AAC(F)ACC(F)ACC(F)ACC (F)ACC(F)ACC(F)ACU(F)GA | 89 |
| E8-1 | Solid Phase Synthesis | G(M)G(M)G(M)A(M)G(M)A(M)AUACAAGCUACUUGUUCUUUUUGCAG CCACCAUGG(F)ACU(F)ACA(F)AGG(F)ACG(F)ACG(F)ACG(F)AC A(F)AGA(F)UCA(F)UCG(F)ACU(F)AUA(F)AAG(amino) | 90 |
| E8-2 | Solid Phase Synthesis | pACG(F)ACG(F)ACG(F)AUA(F)AAG(F)GUG(F)GCG(F)ACU(F)A UA(F)AGG(F)ACG(F)ACG(F)ACG(F)ACA(F)AAC(F)ACC(F)ACC (F)ACC(F)ACC(F)ACC(F)ACU(F)GA | 91 |

TABLE 22

| | | | |
|---|---|---|---|
| E9 | Same as Example 1 | G(M)G(M)G(M)A(M)G(M)A(M)AUACAAGCUACUUGUUCUUUUUGCAGCC ACCAUGGACUACAAGGACGACGACGACAAGAUCAUCGACUAUAAAGACGACG ACGAUAAAGGUGGCGACUAUAAGGACGACGACGACAAAC(M)ACC(M)ACC (M)ACC(M)ACC(M)ACC(M)ACU(M)G(M)A(M) | 92 |
| E9-1 | Solid Phase Synthesis | G(M)G(M)G(M)A(M)G(M)A(M)AUACAAGCUACUUGUUCUUUUUGCAGCC ACCAUGGACUACAAGGACGACGACGACAAGAUCAUCGACUAUAAAG | 93 |
| E9-2 | Solid Phase Synthesis | pACGACGACGAUAAAGGUGGCGACUAUAAGGACGACGACGACAAAC(M)ACC (M)ACC(M)ACC(M)ACC(M)ACC(M)ACU(M)G(M)A(M) | 94 |
| E10 | Same as Example 1 | G(M)G(M)G(M)A(M)G(M)A(M)AUACAAGCUACUUGUUCUUUUUGCAGCC ACCAUGGACUACAAGGACGACGACGACAAGAUCAUCGACUAUA(M)AAGACG ACGACGAUA(M)AAGGUGGCGACUAUAAGGACGACGACGACA(M)AACACCA CCACCACCACCACU(M)G(M)A(M) | 95 |
| E10-1 | Solid Phase Synthesis | G(M)G(M)G(M)A(M)G(M)A(M)AUACAAGCUACUUGUUCUUUUUGCAGCC ACCAUGGACUACAAGGACGACGACGACAAGAUCAUCGACUAUA(M)AAG | 96 |
| E10-2 | Solid Phase Synthesis | pACGACGACGAUA(M)AAGGUGGCGACUAUAAGGACGACGACGACA(M)AAC ACCACCACCACCACCACU(M)G(M)A(M) | 97 |
| E11 | Same as Example 1 | G(M)G(M)G(M)A(M)G(M)A(M)AUACAAGCUACUUGUUCUUUUUGCAGCC ACCAUGGACUACAAG(M)GACGACGACGACAAG(M)AUCAUCGACUAUAAAG ACGACGACGAUAAAGGUGGCGACUAUAAG(M)GACGACGACGACAAACACCA CCACCACCACCACU(M)G(M)A(M) | 98 |
| E11-1 | Solid Phase Synthesis | G(M)G(M)G(M)A(M)G(M)A(M)AUACAAGCUACUUGUUCUUUUUGCAGCC ACCAUGGACUACAAG(M)GACGACGACGACAAG(M)AUCAUCGACUAUAAAG | 99 |
| E11-2 | Solid Phase Synthesis | pACGACGACGAUAAAGGUGGCGACUAUAAG(M)GACGACGACGACAAACACC ACCACCACCACCACU(M)G(M)A(M) | 100 |
| E12 | Same as Example 1 | G(M)G(M)G(M)A(M)G(M)A(M)AUACAAGCUACUUGUUCUUUUUGCAGCC ACCAUGGACUACAAGGACGACGACGACAAGAUCAUCGACUAU(M)AAAGACG ACGACGAU(M)AAAGGU(M)GGCGACUAU(M)AAGGACGACGACGACAAACA CCACCACCACCACCACU(M)G(M)A(M) | 101 |
| E12-1 | Solid Phase Synthesis | G(M)G(M)G(M)A(M)G(M)A(M)AUACAAGCUACUUGUUCUUUUUGCAGCC ACCAUGGACUACAAGGACGACGACGACAAGAUCAUCGACUAU(M)AAAG | 102 |
| E12-2 | Solid Phase Synthesis | pACGACGACGAU(M)AAAGGU(M)GGCGACUAU(M)AAGGACGACGACGACA AACACCACCACCACCACCACU(M)G(M)A(M) | 103 |
| E13 | Same as Example 1 | G(M)G(M)G(M)A(M)G(M)A(M)AUACAAGCUACUUGUUCUUUUUGCAGCC ACCAUGGAC(M)UACAAGGAC(M)GAC(M)GAC(M)GAC(M)AAGAUCAUCG AC(M)UAUAAAGACGAC(M)GAC(M)GAUAAAGGUGGCGAC(M)UAUAAGGA C(M)GAC(M)GAC(M)GAC(M)AAACACCACCACCACCACCACU(M)G(M)A (M) | 104 |
| E13-1 | Solid Phase Synthesis | G(M)G(M)G(M)A(M)G(M)A(M)AUACAAGCUACUUGUUCUUUUUGCAGCC ACCAUGGAC(M)UACAAGGAC(M)GAC(M)GAC(M)GAC(M)AAGAUCAUCG AC(M)UAUAAAG | 105 |

TABLE 22-continued

| | | | |
|---|---|---|---|
| E13-2 | Solid Phase Synthesis | pACGAC(M)GAC(M)GAUAAAGGUGGCGAC(M)UAUAAGGAC(M)GAC(M)G AC(M)GAC(M)AAACACCACCACCACCACCACU(M)G(M)A(M) | 106 |

TABLE 23

| | | | |
|---|---|---|---|
| E14 | Same as Example 1 | G(M)G(M)G(M)A(M)G(M)A(M)AUACAAGCUACUUGUUCUUUUUGCAGCCA CCAUGGACUACAAGGACGACGACGACAAGAUCAUCGACUAUAAAGACGACGAC GAU(M)AAAGGUGGCGACUAUAAGGACGACGACGACAAACACCACCACCACCA CCACU(M)G(M)A(M) | 107 |
| E14-1 | Solid Phase Synthesis | G(M)G(M)G(M)A(M)G(M)A(M)AUACAAGCUACUUGUUCUUUUUGCAGCCA CCAUGGACUACAAGGACGACGACGACAAGAUCAUCGACUAUAAAG | 108 |
| E14-2 | Solid Phase Synthesis | pACGACGACGAU(M)AAAGGUGGCGACUAUAAGGACGACGACGACAAACACCA CCACCACCACCACU(M)G(M)A(M) | 109 |
| E15 | Same as Example 1 | G(M)G(M)G(M)A(M)G(M)A(M)AUACAAGCUACUUGUUCUUUUUGCAGCCA CCAUGG(F)ACUACAAGG(F)ACG(F)ACG(F)ACG(F)ACAAGAUCAUCG(F) ACUAUAAAGACGACG(F)ACG(F)AUAAAG(F)GUG(F)GCG(F)ACUAUAAG G(F)ACG(F)ACG(F)ACG(F)ACAAACACCACCACCACCACCACU(M)G(M) A(M) | 110 |
| E15-1 | Solid Phase Synthesis | G(M)G(M)G(M)A(M)G(M)A(M)AUACAAGCUACUUGUUCUUUUUGCAGCCA CCAUGG(F)ACUACAAGG(F)ACG(F)ACG(F)ACG(F)ACAAGAUCAUCG(F) ACUAUAAAG | 111 |
| E15-2 | Solid Phase Synthesis | pACGACG(F)ACG(F)AUAAAG(F)GUG(F)GCG(F)ACUAUAAGG(F)ACG (F)ACG(F)ACG(F)ACAAACACCACCACCACCACCACU(M)G(M)A(M) | 112 |
| E16 | Same as Example 1 | G(M)G(M)G(M)A(M)G(M)A(M)AUACAAGCUACUUGUUCUUUUUGCAGCCA CCAUGGACUACAAGGACGACGACGACAAGAUCAUCGACUAUAAAGACGACGAC GAUAAAGGUGGCGACUAUAAGGACGACGACGACAAAC(F)ACC(F)ACC(F)A CC(F)ACC(F)ACC(F)ACU(M)G(M)A(M) | 113 |
| E16-1 | Solid Phase Synthesis | G(M)G(M)G(M)A(M)G(M)A(M)AUACAAGCUACUUGUUCUUUUUGCAGCCA CCAUGGACUACAAGGACGACGACGACAAGAUCAUCGACUAUAAAG | 114 |
| E16-2 | Solid Phase Synthesis | pACGACGACGAUAAAGGUGGCGACUAUAAGGACGACGACGACAAAC(F)ACC (F)ACC(F)ACC(F)ACC(F)ACC(F)ACU(M)G(M)A(M) | 115 |
| E17 | Same as Example 1 | G(M)G(M)G(M)A(M)G(M)A(M)AUACAAGCUACUUGUUCUUUUUGCAGCCA CCAUGGACUACA(F)AGGACGACGACGACA(F)AGA(F)UCA(F)UCGACUAU A(F)AAGACGACGACGAUA(F)AAGGUGGCGACUAUA(F)AGGACGACGACGA CA(F)AACACCACCACCACCACCACU(M)G(M)A(M) | 116 |
| E17-1 | Solid Phase Synthesis | G(M)G(M)G(M)A(M)G(M)A(M)AUACAAGCUACUUGUUCUUUUUGCAGCCA CCAUGGACUACA(F)AGGACGACGACGACA(F)AGA(F)UCA(F)UCGACUAU A(F)AAG | 117 |
| E17-2 | Solid Phase Synthesis | pACGACGACGAUA(F)AAGGUGGCGACUAUA(F)AGGACGACGACGACA(F)A ACACCACCACCACCACCACU(M)G(M)A(M) | 118 |
| E18 | Same as Example 1 | G(M)G(M)G(M)A(M)G(M)A(M)AUACAAGCUACUUGUUCUUUUUGCAGCCA CCAUGGACU(F)ACAAGGACGACGACGACAAGAUCAUCGACU(F)AUAAAGAC GACGACGAUAAAGGUGGCGACU(F)AUAAGGACGACGACGACAAACACCACCA CCACCACCACU(M)G(M)A(M) | 119 |
| E18-1 | Solid Phase Synthesis | G(M)G(M)G(M)A(M)G(M)A(M)AUACAAGCUACUUGUUCUUUUUGCAGCCA CCAUGGACU(F)ACAAGGACGACGACGACAAGAUCAUCGACU(F)AUAAAG | 120 |
| E18-2 | Solid Phase Synthesis | pACGACGACGAUAAAGGUGGCGACU(F)AUAAGGACGACGACGACAAACACCA CCACCACCACCACU(M)G(M)A(M) | 121 |

TABLE 24

| | | | |
|---|---|---|---|
| E19 | Same as Example 1 | G(M)G(M)G(M)A(M)G(M)A(M)AUACAAGCUACUUGUUCUUUUUGCAGCCACC AUGG(F)ACUACAAGG(F)ACG(F)ACG(F)ACG(F)ACAAGAUCAUCG(F)ACU AUAAAGACGACG(F)ACGAUAAAGGUGGCG(F)ACUAUAAGG(F)ACG(F)ACG (F)ACG(F)ACAAACACCACCACCACCACCACU(M)G(M)A(M) | 122 |
| E19-1 | Solid Phase Synthesis | G(M)G(M)G(M)A(M)G(M)A(M)AUACAAGCUACUUGUUCUUUUUGCAGCCACC AUGG(F)ACUACAAGG(F)ACG(F)ACG(F)ACG(F)ACAAGAUCAUCG(F)ACU AUAAAG | 123 |

TABLE 24-continued

| | | | |
|---|---|---|---|
| E19-2 | Solid Phase Synthesis | pACGACG(F)ACGAUAAAGGUGGCG(F)ACUAUAAGG(F)ACG(F)ACG(F)ACG(F)ACAAACACCACCACCACCACCACU(M)G(M)A(M) | 124 |
| E20 | Same as Example 1 | G(M)G(M)G(M)A(M)G(M)A(M)AUACAAGCUACUUGUUCUUUUUGCAGCCACCAUGGAC(F)UAC(F)AAG(F)GAC(F)GAC(F)GAC(F)GAC(F)AAG(F)AUC(F)AUC(F)GAC(F)UAU(F)AAA(F)GACGAC(F)GAC(F)GAU(F)AAA(F)GGU(F)GGC(F)GAC(F)UAU(F)AAG(F)GAC(F)GAC(F)GAC(F)GAC(F)AAA(F)CAC(F)CAC(F)CAC(F)CAC(F)CAC(F)CAC(F)U(M)G(M)A(M) | 125 |
| E20-1 | Solid Phase Synthesis | G(M)G(M)G(M)A(M)G(M)A(M)AUACAAGCUACUUGUUCUUUUUGCAGCCACCAUGGAC(F)UAC(F)AAG(F)GAC(F)GAC(F)GAC(F)GAC(F)AAG(F)AUC(F)AUC(F)GAC(F)UAU(F)AAA(F)G | 126 |
| E20-2 | Solid Phase Synthesis | pACGAC(F)GAC(F)GAU(F)AAA(F)GGU(F)GGC(F)GAC(F)UAU(F)AAG(F)GAC(F)GAC(F)GAC(F)GAC(F)AAA(F)CAC(F)CAC(F)CAC(F)CAC(F)CAC(F)CAC(F)U(M)G(M)A(M) | 127 |
| E21 | Same as Example 1 | G(M)G(M)G(M)A(M)G(M)A(M)AUACAAGCUACUUGUUCUUUUUGCAGCCACCAUGG(F)AC(F)U(F)AC(F)A(F)AG(F)G(F)AC(F)G(F)AC(F)G(F)AC(F)G(F)AC(F)A(F)AG(F)A(F)UC(F)A(F)UC(F)G(F)AC(F)U(F)AU(F)A(F)AA(F)GACGAC(F)G(F)AC(F)G(F)AU(F)A(F)AA(F)G(F)GU(F)G(F)GC(F)G(F)AC(F)U(F)AU(F)A(F)AG(F)G(F)AC(F)G(F)AC(F)G(F)AC(F)G(F)AC(F)A(F)AA(F)C(F)AC(F)C(F)AC(F)C(F)AC(F)C(F)AC(F)C(F)AC(F)C(F)AC(F)U(M)G(M)A(M) | 128 |
| E21-1 | Solid Phase Synthesis | G(M)G(M)G(M)A(M)G(M)A(M)AUACAAGCUACUUGUUCUUUUUGCAGCCACCAUGG(F)AC(F)U(F)AC(F)A(F)AG(F)G(F)AC(F)G(F)AC(F)G(F)AC(F)G(F)AC(F)A(F)AG(F)A(F)UC(F)A(F)UC(F)G(F)AC(F)U(F)AU(F)A(F)AA(F)G | 129 |
| E21-2 | Solid Phase Synthesis | pACGAC(F)G(F)AC(F)G(F)AU(F)A(F)AA(F)G(F)GU(F)G(F)GC(F)G(F)AC(F)U(F)AU(F)A(F)AG(F)G(F)AC(F)G(F)AC(F)G(F)AC(F)G(F)AC(F)A(F)AA(F)C(F)AC(F)C(F)AC(F)C(F)AC(F)C(F)AC(F)C(F)AC(F)C(F)AC(F)U(M)G(M)A(M) | 130 |
| E22 | Same as Example 1 | GGGA(M)GA(M)A(M)UA(M)CA(M)A(M)GCUA(M)CUUGUUCUUUUUGCA(M)GCCA(M)CCAUGGACUACAAGGACGACGACGACAAGAUCAUCGACUAUAAAGACGACGACGAUAAAGGUGGCGACUAUAAGGACGACGACGACAAACACCACCACCACCACCACUGA | 131 |
| E22-1 | Solid Phase Synthesis | GGGA(M)GA(M)A(M)UA(M)CA(M)A(M)GCUA(M)CUUGUUCUUUUUGCA(M)GCCA(M)CCAUGGACUACAAGGACGACGACGACAAGAUCAUCGACUAUAAAG | 132 |
| E22-2 | Solid Phase Synthesis | pACGACGACGAUAAAGGUGGCGACUAUAAGGACGACGACGACAAACACCACCACCACCACCACUGA | 133 |

TABLE 25

| | | | |
|---|---|---|---|
| E23 | Same as Example 1 | GGGA(F)GA(F)A(F)UA(F)CA(F)A(F)GCUA(F)CUUGUUCUUUUUGCA(F)GCCA(F)CCAUGGACUACAAGGACGACGACGACAAGAUCAUCGACUAUAAAGACGACGACGAUAAAGGUGGCGACUAUAAGGACGACGACGACAAACACCACCACCACCACCACUGA | 134 |
| E23-1 | Solid Phase Synthesis | GGGA(F)GA(F)A(F)UA(F)CA(F)A(F)GCUA(F)CUUGUUCUUUUUGCA(F)GCCA(F)CCAUGGACUACAAGGACGACGACGACAAGAUCAUCGACUAUAAAG | 135 |
| E23-2 | Solid Phase Synthesis | pACGACGACGAUAAAGGUGGCGACUAUAAGGACGACGACGACAAACACCACCACCACCACCACUGA | 136 |
| E24 | Same as Example 1 | G(M)G(M)G(M)A(M)G(M)A(M)AUACAAGCUACUUGUUCUUUUUGCAGCCACCAUGGACUACAAGGACGACGACGACAAGAUCAUCGACUAUAAAGACGACGACGAUAAAGGUGGCGACUAUAAGGAC(F)GACGACGACAAACACCACCACCACCACCACU(M)G(M)A(M) | 137 |
| E24-1 | Solid Phase Synthesis | G(M)G(M)G(M)A(M)G(M)A(M)AUACAAGCUACUUGUUCUUUUUGCAGCCACCAUGGACUACAAGGACGACGACGACAAGAUCAUCGACUAUAAAG | 138 |
| E24-2 | Solid Phase Synthesis | pACGACGACGAUAAAGGUGGCGACUAUAAGGAC(F)GACGACGACAAACACCACCACCACCACCACU(M)G(M)A(M) | 139 |
| E25 | Same as Example 1 | G(M)G(M)G(M)A(M)G(M)A(M)AUACAAGCUACUUGUUCUUUUUGCAGCCACCAUGGACUACAAGGACGACGACGACAAGAUCAUCGACUAUAAAGACGACGACGAUAAAGGUGGCGACUAUAAGGAC(F)GAC(F)GACGACAAACACCACCACCACCACCACU(M)G(M)A(M) | 140 |
| E25-1 | Solid Phase Synthesis | G(M)G(M)G(M)A(M)G(M)A(M)AUACAAGCUACUUGUUCUUUUUGCAGCCACCAUGGACUACAAGGACGACGACGACAAGAUCAUCGACUAUAAAG | 141 |

TABLE 25-continued

| | | | |
|---|---|---|---|
| E25-2 | Solid Phase Synthesis | pACGACGACGAUAAAGGUGGCGACUAUAAGGAC(F)GAC(F)GACGACAAACACC ACCACCACCACCACU(M)G(M)A(M) | 142 |
| E26 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCGACUAUAAGG(M)ACGACGACGACAAACACCACCACCACCACCACU (M)G(M)A(M) | 143 |
| E26-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 144 |
| E26-2 | Solid Phase Synthesis | pACGACGACGAUAAAGGUGGCGACUAUAAGG(M)ACGACGACGACAAACACCACC ACCACCACCACU(M)G(M)A(M) | 145 |
| E27 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCGACUAUAAGG(M)ACG(M)ACGACGACAAACACCACCACCACCACCA CU(M)G(M)A(M) | 146 |
| E27-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 147 |
| E27-2 | Solid Phase Synthesis | pACGACGACGAUAAAGGUGGCGACUAUAAGG(M)ACG(M)ACGACGACAAACACC ACCACCACCACCACU(M)G(M)A(M) | 148 |

TABLE 26

| | | | |
|---|---|---|---|
| E28 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCGACUAUAAGGAC(M)GACGACGACAAACACCACCACCACCACCACU (M)G(M)A(M) | 149 |
| E28-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 150 |
| E28-2 | Solid Phase Synthesis | pACGACGACGAUAAAGGUGGCGACUAUAAGGAC(M)GACGACGACAAACACCACC ACCACCACCACU(M)G(M)A(M) | 151 |
| E29 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCGACUAUAAGG(M)ACG(M)ACGACGACAAACACCACCACCACCACCA CU(M)G(M)A(M) | 152 |
| E29-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 153 |
| E29-2 | Solid Phase Synthesis | pACGACGACGAUAAAGGUGGCGACUAUAAGGAC(M)GAC(M)GACGACAAACACC ACCACCACCACCACU(M)G(M)A(M) | 154 |
| E30 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCGACUAUAAGgACGACGACGACAAACACCACCACCACCACCACU(M)G (M)A(M) | 155 |
| E30-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 156 |
| E30-2 | Solid Phase Synthesis | pACGACGACGAUAAAGGUGGCGACUAUAAGgACGACGACGACAAACACCACCACC ACCACCACU(M)G(M)A(M) | 157 |
| E31 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCGACUAUAAGGAcGAcGACGACAAACACCACCACCACCACCACU(M)G (M)A(M) | 158 |
| E31-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 159 |
| E31-2 | Solid Phase Synthesis | pACGACGACGAUAAAGGUGGCGACUAUAAGGAcGAcGACGACAAACACCACCACC ACCACCACU(M)G(M)A(M) | 160 |
| E32 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCGACUAUAAGG(L)ACGACGACGACAAACACCACCACCACCACCACU (M)G(M)A(M) | 161 |

TABLE 26-continued

| | | | |
|---|---|---|---|
| E32-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 162 |
| E32-2 | Solid Phase Synthesis | pACGACGACGAUAAAGGUGGCGACUAUAAGG(L)ACGACGACGACAAACACCACC ACCACCACCACU(M)G(M)A(M) | 163 |

TABLE 27

| | | | |
|---|---|---|---|
| E33 | Same as Example 1 | G(M)G(M)G(M)A(M)G(M)A(M)AUACAAGCUACUUGUUCUUUUUGCAGCCA CCAUGGACUACAAGGACGACGACGACAAGAUCAUCGACUAUAAAGACGACGAC GAUAAAGGUGGCGACUAUAAGG(L)ACG(L)ACGACGACAAACACCACCACCA CCACCACU(M)G(M)A(M) | 164 |
| E33-1 | Solid Phase Synthesis | G(M)G(M)G(M)A(M)G(M)A(M)AUACAAGCUACUUGUUCUUUUUGCAGCCA CCAUGGACUACAAGGACGACGACGACAAGAUCAUCGACUAUAAAG | 165 |
| E33-2 | Solid Phase Synthesis | pACGACGACGAUAAAGGUGGCGACUAUAAGG(L)ACG(L)ACGACGACAAACA CCACCACCACCACCACU(M)G(M)A(M) | 166 |
| E34 | Same as Example 1 | G(M)G(M)G(M)A(M)G(M)A(M)AUACAAGCUACUUGUUCUUUUUGCAGCCA CCAUGGACUACAAGGACGACGACGACAAGAUCAUCGACUAUAAAGACGACGAC GAUAAAGGUGGCGACUAUAAGGAC(L)GACGACGACAAACACCACCACCACCA CCACU(M)G(M)A(M) | 167 |
| E34-1 | Solid Phase Synthesis | G(M)G(M)G(M)A(M)G(M)A(M)AUACAAGCUACUUGUUCUUUUUGCAGCCA CCAUGGACUACAAGGACGACGACGACAAGAUCAUCGACUAUAAAG | 168 |
| E34-2 | Solid Phase Synthesis | pACGACGACGAUAAAGGUGGCGACUAUAAGGAC(L)GACGACGACAAACACCA CCACCACCACCACU(M)G(M)A(M) | 169 |
| E35 | Same as Example 1 | G(M)G(M)G(M)A(M)G(M)A(M)AUACAAGCUACUUGUUCUUUUUGCAGCCA CCAUGGACUACAAGGACGACGACGACAAGAUCAUCGACUAUAAAGACGACGAC GAUAAAGGUGGCGACUAUAAGGAC(L)GAC(L)GACGACAAACACCACCACCA CCACCACU(M)G(M)A(M) | 170 |
| E35-1 | Solid Phase Synthesis | G(M)G(M)G(M)A(M)G(M)A(M)AUACAAGCUACUUGUUCUUUUUGCAGCCA CCAUGGACUACAAGGACGACGACGACAAGAUCAUCGACUAUAAAG | 171 |
| E35-2 | Solid Phase Synthesis | pACGACGACGAUAAAGGUGGCGACUAUAAGGAC(L)GAC(L)GACGACAAACA CCACCACCACCACCACU(M)G(M)A(M) | 172 |
| E36 | Same as Example 1 | G(M)G(M)G(M)A(M)G(M)A(M)AUACAAGCUACUUGUUCUUUUUGCAGCCA CCAUGGACUACAAGGACGACGACGACAAGAUCAUCGACUAUAAAGACGACGAC GAUAAAGGUGGCGACUAUAAGGA(M)CGACGACGACAAACACCACCACCACCA CCACU(M)G(M)A(M) | 173 |
| E36-1 | Solid Phase Synthesis | G(M)G(M)G(M)A(M)G(M)A(M)AUACAAGCUACUUGUUCUUUUUGCAGCCA CCAUGGACUACAAGGACGACGACGACAAGAUCAUCGACUAUAAAG | 174 |
| E36-2 | Solid Phase Synthesis | pACGACGACGAUAAAGGUGGCGACUAUAAGGA(M)CGACGACGACAAACACCA CCACCACCACCACU(M)G(M)A(M) | 175 |
| E37 | Same as Example 1 | G(M)G(M)G(M)A(M)G(M)A(M)AUACAAGCUACUUGUUCUUUUUGCAGCCA CCAUGGACUACAAGGACGACGACGACAAGAUCAUCGACUAUAAAGACGACGAC GAUAAAGGUGGCGACUAUAAGGA(F)CGACGACGACAAACACCACCACCACCA CCACU(M)G(M)A(M) | 176 |
| E37-1 | Solid Phase Synthesis | G(M)G(M)G(M)A(M)G(M)A(M)AUACAAGCUACUUGUUCUUUUUGCAGCCA CCAUGGACUACAAGGACGACGACGACAAGAUCAUCGACUAUAAAG | 177 |
| E37-2 | Solid Phase Synthesis | pACGACGACGAUAAAGGUGGCGACUAUAAGGA(F)CGACGACGACAAACACCA CCACCACCACCACU(M)G(M)A(M) | 178 |

TABLE 28

| | | | |
|---|---|---|---|
| E38 | Same as Reference Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino)AC GACGACGAUAAAGGUGGCGACUAUAAGG(F)ACGACGACGACAAACACCACCACC ACCACCACU(M)G(M)A(M) | 179 |
| E38-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino) | 180 |

TABLE 28-continued

| | | | |
|---|---|---|---|
| E38-2 | Solid Phase Synthesis | pACGACGACGAUAAAGGUGGCGACUAUAAGG(F)ACGACGACGACAAACACCACC ACCACCACCACU(M)G(M)A(M) | 181 |
| E39 | Same as Reference Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino)ACGAC GACGAUAAAGGUGGCGACUAUAAGG(F)ACG(F)ACGACGACAAACACCACCACC ACCACCACU(M)G(M)A(M) | 182 |
| E39-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino) | 183 |
| E39-2 | Solid Phase Synthesis | pACGACGACGAUAAAGGUGGCGACUAUAAGG(F)ACG(F)ACGACGACAAACACC ACCACCACCACCACU(M)G(M)A(M) | 184 |
| E40 | Same as Reference Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino)ACGAC GACGAUAAAGGUGGCGACUAUAAGGAC(F)GACGACGACAAACACCACCACCACC ACCACU(M)G(M)A(M) | 185 |
| E40-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino) | 186 |
| E40-2 | Solid Phase Synthesis | pACGACGACGAUAAAGGUGGCGACUAUAAGGAC(F)GACGACGACAAACACCACC ACCACCACCACU(M)G(M)A(M) | 187 |
| E41 | Same as Reference Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino)ACGAC GACGAUAAAGGUGGCGACUAUAAGGAC(F)GAC(F)GACGACAAACACCACCACC ACCACCACU(M)G(M)A(M) | 188 |
| E41-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino) | 189 |
| E41-2 | Solid Phase Synthesis | pACGACGACGAUAAAGGUGGCGACUAUAAGGAC(F)GAC(F)GACGACAAACACC ACCACCACCACCACU(M)G(M)A(M) | 190 |
| E42 | Same as Reference Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino)ACGAC GACGAUAAAGGUGGCGACUAUAAGG(M)ACGACGACGACAAACACCACCACCACC ACCACU(M)G(M)A(M) | 191 |
| E42-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino) | 192 |
| E42-2 | Solid Phase Synthesis | pACGACGACGAUAAAGGUGGCGACUAUAAGG(M)ACGACGACGACAAACACCACC ACCACCACCACU(M)G(M)A(M) | 193 |

TABLE 29

| | | | |
|---|---|---|---|
| E43 | Same as Reference Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino)ACGAC GACGAUAAAGGUGGCGACUAUAAGG(M)ACG(M)ACGACGACAAACACCACCACC ACCACCACU(M)G(M)A(M) | 194 |
| E43-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino) | 195 |
| E43-2 | Solid Phase Synthesis | pACGACGACGAUAAAGGUGGCGACUAUAAGG(M)ACG(M)ACGACGACAAACACC ACCACCACCACCACU(M)G(M)A(M) | 196 |
| E44 | Same as Reference Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino)ACGAC GACGAUAAAGGUGGCGACUAUAAGGAC(M)GACGACGACAAACACCACCACCACC ACCACU(M)G(M)A(M) | 197 |
| E44-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino) | 198 |
| E44-2 | Solid Phase Synthesis | pACGACGACGAUAAAGGUGGCGACUAUAAGGAC(M)GACGACGACAAACACCACC ACCACCACCACU(M)G(M)A(M) | 199 |
| E45 | Same as Reference Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino)ACGAC GACGAUAAAGGUGGCGACUAUAAGGAC(M)GAC(M)GACGACAAACACCACCACC ACCACCACU(M)G(M)A(M) | 200 |

TABLE 29-continued

| | | | |
|---|---|---|---|
| E45-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG(amino) | 201 |
| E45-2 | Solid Phase Synthesis | pACGACGACGAUAAAGGUGGCGACUAUAAGGAC(M)GAC(M)GACGACAAACACC ACCACCACCACCACU(M)G(M)A(M) | 202 |
| E46 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCGACUAUAAGGACGACGACGACAAACACCACCACCACCACCACU(M)G (M)A(M)AAAAAAAAAAAAAAAAAAAA | 203 |
| E46-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 204 |
| E46-2 | Solid Phase Synthesis | pACGACGACGAUAAAGGUGGCGACUAUAAGGACGACGACGACAAACACCACCACC ACCACCACU(M)G(M)A(M)AAAAAAAAAAAAAAAAAAAA | 205 |

TABLE 30

| | | | |
|---|---|---|---|
| E47 | Same as Example 1 | G(L)G(L)G(L)A(L)G(L)A(L)AUACAAGCUACUUGUUCUUUUUGCAGCCACCAUG G(F)ACU(F)ACA(F)AGG(F)ACG(F)ACG(F)ACG(F)ACA(F)AGA(F)UCA(F) UCG(F)ACU(F)AUA(F)AAGACGACG(F)ACG(F)AUA(F)AAG(F)GUG(F)GCG (F)ACU(F)AUA(F)AGG(F)ACG(F)ACG(F)ACG(F)ACA(F)AAC(F)ACC(F)A CC(F)ACC(F)ACC(F)ACC(F)ACU(L)G(L)A(L) | 206 |
| E47-1 | Solid Phase Synthesis | G(L)G(L)G(L)A(L)G(L)A(L)AUACAAGCUACUUGUUCUUUUUGCAGCCACCAUG G(F)ACU(F)ACA(F)AGG(F)ACG(F)ACG(F)ACG(F)ACA(F)AGA(F)UCA(F) UCG(F)ACU(F)AUA(F)AAG | 207 |
| E47-2 | Solid Phase Synthesis | pACGACG(F)ACG(F)AUA(F)AAG(F)GUG(F)GCG(F)ACU(F)AUA(F)AGG(F) ACG(F)ACG(F)ACG(F)ACA(F)AAC(F)ACC(F)ACC(F)ACC(F)ACC(F)ACC (F)ACU(L)G(L)A(L) | 208 |
| E48 | Same as Example 1 | G(MOE)G(MOE)G(MOE)A(MOE)G(MOE)A(MOE)AUACAAGCUACUUGUUCUUUUU GCAGCCACCAUGG(F)ACU(F)ACA(F)AGG(F)ACG(F)ACG(F)ACG(F)ACA(F) AGA(F)UCA(F)UCG(F)ACU(F)AUA(F)AAGACGACG(F)ACG(F)AUA(F)AAG (F)GUG(F)GCG(F)ACU(F)AUA(F)AGG(F)ACG(F)ACG(F)ACG(F)ACA(F)A AC(F)ACC(F)ACC(F)ACC(F)ACC(F)ACC(F)ACU(MOE)G(MOE)A(MOE) | 209 |
| E48-1 | Solid Phase Synthesis | G(MOE)G(MOE)G(MOE)A(MOE)G(MOE)A(MOE)AUACAAGCUACUUGUUCUUUUU GCAGCCACCAUGG(F)ACU(F)ACA(F)AGG(F)ACG(F)ACG(F)ACG(F)ACA(F) AGA(F)UCA(F)UCG(F)ACU(F)AUA(F)AAG | 210 |
| E48-2 | Solid Phase Synthesis | pACGACG(F)ACG(F)AUA(F)AAG(F)GUG(F)GCG(F)ACU(F)AUA(F)AGG(F) ACG(F)ACG(F)ACG(F)ACA(F)AAC(F)ACC(F)ACC(F)ACC(F)ACC(F)ACC (F)ACU(MOE)G(MOE)A(MOE) | 211 |
| E49 | Same as Example 1 | G(MOE)G(MOE)G(MOE)A(MOE)G(MOE)A(MOE)AUACAAGCUACUUGUUCUUUUU GCAGCCACCAUGG(F)ACU(F)ACA(F)AGG(F)ACG(F)ACG(F)ACG(F)ACA(F) AGA(F)UCA(F)UCG(F)ACU(F)AUA(F)AAGACGACG(F)ACG(F)AUA(F)AAG (F)GUG(F)GCG(F)ACU(F)AUA(F)AGG(F)ACG(F)ACG(F)ACG(F)ACA(F)A AC(F)ACC(F)ACC(F)ACC(F)ACC(F)ACC(F)ACU(MOE)G(MOE)A(MOE)AAA AAAAAAAAAAAAAAAAA | 212 |
| E49-1 | Solid Phase Synthesis | G(MOE)G(MOE)G(MOE)A(MOE)G(MOE)A(MOE)AUACAAGCUACUUGUUCUUUUU GCAGCCACCAUGG(F)ACU(F)ACA(F)AGG(F)ACG(F)ACG(F)ACG(F)ACA(F) AGA(F)UCA(F)UCG(F)ACU(F)AUA(F)AAG | 213 |
| E49-2 | Solid Phase Synthesis | pACGACG(F)ACG(F)AUA(F)AAG(F)GUG(F)GCG(F)ACU(F)AUA(F)AGG(F) ACG(F)ACG(F)ACG(F)ACA(F)AAC(F)ACC(F)ACC(F)ACC(F)ACC(F)ACC (F)ACU(MOE)G(MOE)A(MOE)AAAAAAAAAAAAAAAAAAAA | 214 |

TABLE 31

| | | | |
|---|---|---|---|
| E50 | Same as Example 1 | G(MOE)G(MOE)G(MOE)A(MOE)G(MOE)A(MOE)AUACAAGCUACUUGUUCUUU UUGCAGCCACCAUGG(F)ACU(F)ACA(F)AGG(F)ACG(F)ACG(F)ACG(F)AC A(F)AGA(F)UCA(F)UCG(F)ACU(F)AUA(F)AAGACGACG(F)ACG(F)AUA (F)AAG(F)GUG(F)GCG(F)ACU(F)AUA(F)AGG(F)ACG(F)ACG(F)ACG(F) ACA(F)AAC(F)ACC(F)ACC(F)ACC(F)ACC(F)ACC(F)ACU(F)GAA(F)AA A(F)AAA(F)AAA(F)AAA(F)AAA(F)AA(MOE)A(MOE)A(MOE) | 215 |

TABLE 31-continued

| | | | |
|---|---|---|---|
| E50-1 | Solid Phase Synthesis | G(MOE)G(MOE)G(MOE)A(MOE)G(MOE)A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 216 |
| E50-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(F)GAA(F)AAA(F)AAA(F)AAA(F)AAA(F)AAA(F)AA(MOE)A(MOE)A(MOE) | 217 |
| E51 | Same as Example 1 | G(MOE)G(MOE)G(MOE)A(MOE)G(MOE)A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(MOE)G(MOE)A(MOE)A(F)AAA(F)AAA(F)AAA(F)AAA(F)AAA(F)AA(MOE)A(MOE)A(MOE) | 218 |
| E51-1 | Solid Phase Synthesis | G(MOE)G(MOE)G(MOE)A(MOE)G(MOE)A(MOE)AUACAAGCUACUUGUUCUUUUUGCAGCCACCAUGG(F)ACU(F)ACA(F)AGG(F)ACG(F)ACG(F)ACG(F)ACA(F)AGACF)UCA(F)UCG(F)ACU(F)AUA(F)AAG | 219 |
| E51-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(MOE)G(MOE)A(MOE)A(F)AAA(F)AAA(F)AAA(F)AAA(F)AAA(F)AA(MOE)A(MOE)A(MOE) | 220 |
| E52 | Same as Example 1 | G(MOE)G(MOE)G(MOE)A(MOE)G(MOE)A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)ACU(F)AUA(FJAGG(F)ACG(F)ACG(F)ACG(F)ACA(F)AAC(F)ACC(F)ACC(F)ACC(F)ACC(F)ACC(F)ACU(F)GAA(F)AAA(F)AAA(F)AAA(F)AAA(F)AAA(F)AA(MOE)A(MOE)A(MOE) | 221 |
| E52-1 | Solid Phase Synthesis | G(MOE)G(MOE)G(MOE)A(MOE)G(MOE)A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 222 |
| E52-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(F)GAA(F)AAA(F)AAA(F)AAA(F)AAA(F)AAACF)AA(MOE)A(MOE)A(MOE) | 223 |

TABLE 32

| | | | |
|---|---|---|---|
| E53 | Same as Example 1 | G(MOE)G(MOE)G(MOE)A(MOE)G(MOE)A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)ACU(F)AUA(FJAGG(F)ACG(F)ACG(F)ACG(F)ACA(F)AAC(F)ACC(F)ACC(F)ACC(F)ACC(F)ACC(F)ACU(MOE)G(MOE)A(MOE)A(F)AAA(F)AAA(F)AAA(F)AAA(F)AAA(F)AA(MOE)A(MOE)A(MOE) | 224 |
| E53-1 | Solid Phase Synthesis | G(MOE)G(MOE)G(MOE)A(MOE)G(MOE)A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 225 |
| E53-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(MOE)G(MOE)A(MOE)A(F)AAA(F)AAA(F)AAA(F)AAA(F)AAA(F)AA(MOE)A(MOE)A(MOE) | 226 |
| E54 | Same as Example 1 | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M)AAAAAAAAAAAAAAAAAAA | 227 |
| E54-1 | Solid Phase Synthesis | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 228 |
| E54-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M)AAAAAAAAAAAAAAAAAAA | 229 |

TABLE 32-continued

| | | | |
|---|---|---|---|
| E55 | Same as Example 1 | GGGAm6(M)GAm6(M)Am6(M)UAm6(M)CAm6(M)Am6(M)GCUAm6(M)CUUGUUCUUUUUGCAm6(M)GCCAm6(M)CCAUGGACUACAAGGACGACGACGACAAGAUCAUCGACUAUAAACGACGACGAUAAAGGUGGCGACUAUAAGGACGACGACGACAAACACCACCACCACCACCACUGA | 230 |
| E55-1 | Solid Phase Synthesis | GGGAm6(M)GAm6(M)Am6(M)UAm6(M)CAm6(M)Am6(M)GCUAm6(M)CUUGUUCUUUUUGCAm6(M)GCCAm6(M)CCAUGGACUACAAGGACGACGACGACAAGAUCAUCGACUAUAAAG | 231 |
| E55-2 | Solid Phase Synthesis | pACGACGACGAUAAAGGUGGCGACUAUAAGGACGACGACGACAAACACCACCACCACCACCACUGA | 232 |
| E56 | Same as Example 1 | GGGAm6(F)GAm6(F)Am6(F)UAm6(F)CAm6(F)Am6(F)GCUAm6(F)CUUGUUCUUUUUGCAm6(F)GCCAm6(F)CCAUGGACUACAAGGACGACGACGACAAGAUCAUCGACUAUAAAGACGACGACGAUAAAGGUGGCGACUAUAAGGACGACGACGACAAACACCACCACCACCACCACUGA | 233 |
| E56-1 | Solid Phase Synthesis | GGGAm6(F)GAm6(F)Am6(F)UAm6(F)CAm6(F)Am6(F)GCUAm6(F)CUUGUUCUUUUUGCAm6(F)GCCAm6(F)CCAUGGACUACAAGGACGACGACGACAAGAUCAUCGACUAUAAAG | 234 |
| E56-2 | Solid Phase Synthesis | pACGACGACGAUAAAGGUGGCGACUAUAAGGACGACGACGACAAACACCACCACCACCACCACUGA | 235 |

TABLE 33

| | | | |
|---|---|---|---|
| E57 | Same as Example 1 | GGGAe6(M)GAe6(M)Ae6(M)UAe6(M)CAe6(M)Ae6(M)GCUAe6(M)CUUGUUCUUUUUGCAe6(M)GCCAe6(M)CCAUGGACUACAAGGACGACGACGACAAGAUCAUCGACUAUAAAGACGACGACGAUAAAGGUGGCGACUAUAAGGACGACGACGACAAACACCACCACCACCACCACUGA | 236 |
| E57-1 | Solid Phase Synthesis | GGGAe6(M)GAe6(M)Ae6(M)UAe6(M)CAe6(M)Ae6(M)GCUAe6(M)CUUGUUCUUUUUGCAe6(M)GCCAe6(M)CCAUGGACUACAAGGACGACGACGACAAGAUCAUCGACUAUAAAG | 237 |
| E57-2 | Solid Phase Synthesis | pACGACGACGAUAAAGGUGGCGACUAUAAGGACGACGACGACAAACACCACCACCACCACCACUGA | 238 |
| E58 | Same as Example 1 | GGGAe6(F)GAe6(F)Ae6(F)UAe6(F)CAe6(F)Ae6(F)GCUAe6(F)CUUGUUCUUUUUGCAe6(F)GCCAe6(F)CCAUGGACUACAAGGACGACGACGACAAGAUCAUCGACUAUAAAGACGACGACGAUAAAGGUGGCGACUAUAAGGACGACGACGACAAACACCACCACCACCACCACUGA | 239 |
| E58-1 | Solid Phase Synthesis | GGGAe6(F)GAe6(F)Ae6(F)UAe6(F)CAe6(F)Ae6(F)GCUAe6(F)CUUGUUCUUUUUGCAe6(F)GCCAe6(F)CCAUGGACUACAAGGACGACGACGACAAGAUCAUCGACUAUAAAG | 240 |
| E58-2 | Solid Phase Synthesis | pACGACGACGAUAAAGGUGGCGACUAUAAGGACGACGACGACAAACACCACCACCACCACCACUGA | 241 |
| E59 | Same as Example 1 | G(M)G(M)G(M)Am6(M)G(M)Am6(M)Am6(M)UAm6(M)CAm6(M)Am6(M)GCUAm6(M)CUUGUUCUUUUUGCAm6(M)GCCAm6(M)CCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 242 |
| E59 1 | Solid Phase Synthesis | G(M)G(M)G(M)Am6(M)G(M)Am6(M)Am6(M)UAm6(M)CAm6(M)Am6(M)GCUAm6(M)CUUGUUCUUUUUGCAm6(M)GCCAm6(M)CCAUGG(F)ACU(F)ACA(F)AGG(F)ACG(F)ACG(F)ACG(F)ACA(F)AGA(F)UCA(F)UCG(F)ACU(F)AUA(F)AAG | 243 |
| E59-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 244 |
| E60 | Same as Example 1 | G(M)G(M)G(M)Am6(F)G(M)Am6(F)Am6(F)UAm6(F)CAm6(F)Am6(F)GCUAm6(F)CUUGUUCUUUUUGCAm6(F)GCCAm6(F)CCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 245 |
| E60-1 | Solid Phase Synthesis | G(M)G(M)G(M)Am6(F)G(M)Am6(F)Am6(F)UAm6(F)CAm6(F)Am6(F)GCUAm6(F)CUUGUUCUUUUUGCAm6(F)GCCAm6(F)CCAUGG(F)ACU(F)ACA(F)AGG(F)ACG(F)ACG(F)ACG(F)ACA(F)AGA(F)UCA(F)UCG(F)ACU(F)AUA(F)AAG | 246 |

TABLE 33-continued

| | | | |
|---|---|---|---|
| E60-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 247 |

TABLE 34

| | | | |
|---|---|---|---|
| E61 | Same as Example 1 | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)UGG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 248 |
| E61-1 | Solid Phase Synthesis | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 249 |
| E61-2 | Solid Phase Synthesis | pACGACG(F)ACG(F)AUA(F)AAG(F)GUG(F)GCG(F)UGG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 250 |
| E62 | Same as Example 1 | G(M)G(M)G(M)A(M)G(M)A(M)AUACAAGCUACUUGUUCUUUUUGCAGCCACCAUGGACUACAAGGACGACGACGACAAGAUCAUCGACUAUAAAGACGACGACGAUAAAGGUGGCGUGGACUAUAAGGACGACGACGACAAACACCACCACCACCACCACU(M)G(M)A(M) | 251 |
| E62-1 | Solid Phase Synthesis | G(M)G(M)G(M)A(M)G(M)A(M)AUACAAGCUACUUGUUCUUUUUGCAGCCACCAUGGACUACAAGGACGACGACGACAAGAUCAUCGACUAUAAAG | 252 |
| E62-2 | Solid Phase Synthesis | pACGACGACGAUAAAGGUGGCGUGGACUAUAAGGACGACGACGACAAACACCACCACCACCACCACU(M)G(M)A(M) | 253 |
| E63 | Same as Example 1 | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCC(F)CCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 254 |
| E63-1 | Solid Phase Synthesis | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 255 |
| E63-2 | Solid Phase Synthesis | pACGACG(F)ACG(F)AUA(F)AAG(F)GUG(F)GCC(F)CCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 256 |
| E64 | Same as Example 1 | G(M)G(M)G(M)A(M)G(M)A(M)AUACAAGCUACUUGUUCUUUUUGCAGCCACCAUGGACUACAAGGACGACGACGACAAGAUCAUCGACUAUAAAGACGACGACGAUAAAGGUGGCCCCGACUAUAAGGACGACGACGACAAACACCACCACCACCACCACU(M)G(M)A(M) | 257 |
| E64-1 | Solid Phase Synthesis | G(M)G(M)G(M)A(M)G(M)A(M)AUACAAGCUACUUGUUCUUUUUGCAGCCACCAUGGACUACAAGGACGACGACGACAAGAUCAUCGACUAUAAAG | 258 |
| E64-2 | Solid Phase Synthesis | pACGACGACGAUAAAGGUGGCCCCGACUAUAAGGACGACGACGACAAACACCACCACCACCACCACU(M)G(M)A(M) | 259 |

TABLE 35

| | | | |
|---|---|---|---|
| E65 | Same as Example 1 | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCA(F)CCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 260 |
| E65-1 | Solid Phase Synthesis | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 261 |

TABLE 35-continued

| | | | |
|---|---|---|---|
| E65-2 | Solid Phase Synthesis | pACGACG(F)ACG(F)AUA(F)AAG(F)GUG(F)GCA(F)CCG(F)ACU(F)AUA (F)AGG(F)ACG(F)ACG(F)ACG(F)ACA(F)AAC(F)ACC(F)ACC(F)ACC (F)ACC(F)ACC(F)ACU(M)G(M)A(M) | 262 |
| E66 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCACCGACUAUAAGGACGACGACGACAAACACCACCACCACCACU (M)G(M)A(M) | 263 |
| E66-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 264 |
| E66-2 | Solid Phase Synthesis | pACGACGACGAUAAAGGUGGCACCGACUAUAAGGACGACGACGACAAACACCACC ACCACCACCACU(M)G(M)A(M) | 265 |
| E67 | Same as Example 1 | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAGACGACG(F)ACG(F)AUA(F)AAG(F)G UG(F)GCG(F)CCG(F)ACU(F)AUA(F)AGG(F)ACG(F)ACG(F)ACG(F)AC A(F)AAC(F)ACC(F)ACC(F)ACC(F)ACC(F)ACC(F)ACU(M)G(M)A(M) | 266 |
| E67-1 | Solid Phase Synthesis | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAG | 267 |
| E67-2 | Solid Phase Synthesis | pACGACG(F)ACG(F)AUA(F)AAG(F)GUG(F)GCG(F)CCG(F)ACU(F)AUA (F)AGG(F)ACG(F)ACG(F)ACG(F)ACA(F)AAC(F)ACC(F)ACC(F)ACC (F)ACC(F)ACC(F)ACU(M)G(M)A(M) | 268 |
| E68 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCGCCGACUAUAAGGACGACGACGACAAACACCACCACCACCACU (M)G(M)A(M) | 269 |
| E68-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 270 |
| E68-2 | Solid Phase Synthesis | pACGACGACGAUAAAGGUGGCGCCGACUAUAAGGACGACGACGACAAACACCACC ACCACCACCACU(M)G(M)A(M) | 271 |

TABLE 36

| | | | |
|---|---|---|---|
| E69 | Same as Example 1 | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAGACGACG(F)ACG(F)AUA(F)AAG(F)G UG(F)GCC(F)AGG(F)ACU(F)AUA(F)AGG(F)ACG(F)ACG(F)ACG(F)AC A(F)AAC(F)ACC(F)ACC(F)ACC(F)ACC(F)ACC(F)ACU(M)G(M)A(M) | 272 |
| E69-1 | Solid Phase Synthesis | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAG | 273 |
| E69-2 | Solid Phase Synthesis | pACGACG(F)ACG(F)AUA(F)AAG(F)GUG(F)GCC(F)AGG(F)ACU(F)AUA (F)AGG(F)ACG(F)ACG(F)ACG(F)ACA(F)AAC(F)ACC(F)ACC(F)ACC (F)ACC(F)ACC(F)ACU(M)G(M)A(M) | 274 |
| E70 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCCAGGACUAUAAGGACGACGACGACAAACACCACCACCACCACU (M)G(M)A(M) | 275 |
| E70-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 276 |
| E70-2 | Solid Phase Synthesis | pACGACGACGAUAAAGGUGGCCAGGACUAUAAGGACGACGACGACAAACACCACC ACCACCACCACU(M)G(M)A(M) | 277 |
| E71 | Same as Example 1 | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAGACGACG(F)ACG(F)AUA(F)AAG(F)G UG(F)GCU(F)GCG(F)ACU(F)AUA(F)AGG(F)ACG(F)ACG(F)ACG(F)AC A(F)AAC(F)ACC(F)ACC(F)ACC(F)ACC(F)ACC(F)ACU(M)G(M)A(M) | 278 |

TABLE 36-continued

| | | | |
|---|---|---|---|
| E71-1 | Solid Phase Synthesis | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAG | 279 |
| E71-2 | Solid Phase Synthesis | pACGACG(F)ACG(F)AUA(F)AAG(F)GUG(F)GCU(F)GCG(F)ACU(F)AUA (F)AGG(F)ACG(F)ACG(F)ACG(F)ACA(F)AAC(F)ACC(F)ACC(F)ACC (F)ACC(F)ACC(F)ACU(M)G(M)A(M) | 280 |
| E72 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCUGCGACUAUAAGGACGACGACGACAAACACCACCACCACCACCACU (M)G(M)A(M) | 281 |
| E72-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 282 |
| E72-2 | Solid Phase Synthesis | pACGACGACGAUAAAGGUGGCUGCGACUAUAAGGACGACGACGACAAACACCACC ACCACCACCACU(M)G(M)A(M) | 283 |

TABLE 37

| | | | |
|---|---|---|---|
| E73 | Same as Example 1 | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAGACGACG(F)ACG(F)AUA(F)AAG(F)G UG(F)GCA(F)GAG(F)ACU(F)AUA(F)AGG(F)ACG(F)ACG(F)ACG(F)AC A(F)AAC(F)ACC(F)ACC(F)ACC(F)ACC(F)ACC(F)ACU(M)G(M)A(M) | 284 |
| E73-1 | Solid Phase Synthesis | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAG | 285 |
| E73-2 | Solid Phase Synthesis | pACGACG(F)ACG(F)AUA(F)AAG(F)GUG(F)GCA(F)GAG(F)ACU(F)AUA (F)AGG(F)ACG(F)ACG(F)ACG(F)ACACF)AAC(F)ACC(F)ACC(F)ACC (F)ACC(F)ACC(F)ACU(M)G(M)A(M) | 286 |
| E74 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCAGAGACUAUAAGGACGACGACGACAAACACCACCACCACCACCACU (M)G(M)A(M) | 287 |
| E74-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 288 |
| E74-2 | Solid Phase Synthesis | pACGACGACGAUAAAGGUGGCAGAGACUAUAAGGACGACGACGACAAACACCACC ACCACCACCACU(M)G(M)A(M) | 289 |
| E75 | Same as Example 1 | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAGACGACG(F)ACG(F)AUA(F)AAG(F)G UG(F)GCU(F)GGG(F)ACU(F)AUA(F)AGG(F)ACG(F)ACG(F)ACG(F)AC A(F)AAC(F)ACC(F)ACC(F)ACC(F)ACC(F)ACC(F)ACU(M)G(M)A(M) | 290 |
| E75-1 | Solid Phase Synthesis | G(M)G(M)G(M)A(M)G(M)A(M)AUACAAGCUACUUGUUCUUUUUGCAGCCACC AUGG(F)ACU(F)ACA(F)AGG(F)ACG(F)ACG(F)ACG(F)ACA(F)AGA(F) UCA(F)UCG(F)ACU(F)AUA(F)AAG | 291 |
| E75-2 | Solid Phase Synthesis | pACGACG(F)ACG(F)AUA(F)AAG(F)GUG(F)GCU(F)GGG(F)ACU(F)AUA (F)AGG(F)ACG(F)ACG(F)ACG(F)ACA(F)AAC(F)ACC(F)ACC(F)ACC (F)ACC(F)ACC(F)ACU(M)G(M)A(M) | 292 |
| E76 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGACGAUA AAGGUGGCUGGGACUAUAAGGACGACGACGACAAACACCACCACCACCACCACU (M)G(M)A(M) | 293 |
| E76-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 294 |
| E76-2 | Solid Phase Synthesis | pACGACGACGAUAAAGGUGGCUGGGACUAUAAGGACGACGACGACAAACACCACC ACCACCACCACU(M)G(M)A(M) | 295 |

TABLE 38

| | | | |
|---|---|---|---|
| E77 | Same as Example 1 | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 296 |
| E77-1 | Solid Phase Synthesis | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 297 |
| E77-2 | Solid Phase Synthesis | pACGACG(F)ACG(F)AUA(F)AAG(F)GUG(F)GCG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)G(M)A(M) | 298 |
| E78 | Same as Example 1 | G(M)G(M)G(M)A(M)G(M)A(M)AUACAAGCUACUUGUUCUUUUUGCAGCCACCAUGGACUACAAGGACGACGACGACAAGAUCAUCGACUAUAAAGACGACGACGAUAAAGGUGGCGGCGACUAUAAGGACGACGACGACAAACACCACCACCACCACCACU(M)G(M)A(M) | 299 |
| E78-1 | Solid Phase Synthesis | G(M)G(M)G(M)A(M)G(M)A(M)AUACAAGCUACUUGUUCUUUUUGCAGCCACCAUGGACUACAAGGACGACGACGACAAGAUCAUCGACUAUAAAG | 300 |
| E78-2 | Solid Phase Synthesis | pACGACGACGAUAAAGGUGGCGGCGACUAUAAGGACGACGACGACAAACACCACCACCACCACCACU(M)G(M)A(M) | 301 |
| E79 | Solid Phase Synthesis | GGGAGAAUACAAGCUACUUGUUCUUUUUGCAGCCACCAUGGACUAUAAGGACGACGACGACAAAGGUGGCCACCACCACCACCACCACUGA | 302 |
| E80 | Solid Phase Synthesis | G(MOE)G(MOE)G(MOE)A(MOE)G(MOE)A(MOE)AUACAAGCUACUUGUUCUUUUUGCAGCCACCAUGGACUAUAAGGACGACGACGACAAAGGUGGCCACCACCACCACCACCACU(MOE)G(MOE)A(MOE) | 303 |
| E81 | Solid Phase Synthesis | G(F)G(M)G(F)A(M)G(F)A(M)AUACAAGCUACUUGUUCUUUUUGCAGCCACCAUGGACUAUAAGGACGACGACGACAAAGGUGGCCACCACCACCACCACU(M)G(F)A(M) | 304 |
| E82 | Solid Phase Synthesis | GGGAGCCACCAUGGACUAUAAAGACGACGACGAUAAAGGUGGCGACUAUAAGGACGACGACGACAAACACCACCACCACCACCACUGA | 305 |
| E83 | Solid Phase Synthesis | GGGAGCCACCAUGGACUAUAAGGACGACGACGACAAAGGUGGCCACCACCACCACCACCACUGA | 306 |
| E84 | Solid Phase Synthesis | G(MOE)G(MOE)G(MOE)AGCCACCAUGGACUAUAAAGACGACGACGAUAAAGGUGGCGACUAUAAGGACGACGACGACAAACACCACCACCACCACCACU(MOE)G(MOE)A(MOE) | 307 |
| E85 | Solid Phase Synthesis | G(F)G(M)G(F)AGCCACCAUGGACUAUAAAGACGACGACGAUAAAGGUGGCGACUAUAAGGACGACGACGACAAACACCACCACCACCACCACU(M)G(F)A(M) | 308 |

TABLE 39

| | | | |
|---|---|---|---|
| E86 | Same as Example 1 | G(MOE)G(MOE)G(MOE)A(MOE)G(MOE)A(MOE)AUACAAGCUACUUGUUCUUUUUGCAGCCACCAUGGACUACAAGGACGACGACGACAAGAUCAUCGACUAUAAAGACGACGACGAUAAAGGUGGCGACUAUAAGGACGACGACGACAAACACCACCACCACCACCACU(MOE)G(MOE)A(MOE) | 309 |
| E86-1 | Solid Phase Synthesis | G(MOE)G(MOE)G(MOE)A(MOE)G(MOE)A(MOE)AUACAAGCUACUUGUUCUUUUUGCAGCCACCAUGGACUACAAGGACGACGACGACAAGAUCAUCGACUAUAAAG | 310 |
| E86-2 | Solid Phase Synthesis | pACGACGACGAUAAAGGUGGCGACUAUAAGGACGACGACGACAAACACCACCACCACCACCACU(MOE)G(MOE)A(MOE) | 311 |
| E87 | Same as Example 1 | G(F)G(F)G(F)A(F)G(F)A(F)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(F)G(F)A(F) | 312 |
| E87-1 | Solid Phase Synthesis | G(F)G(F)G(F)A(F)G(F)A(F)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 313 |

TABLE 39-continued

| | | | |
|---|---|---|---|
| E87-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(F)G(F)A(F) | 314 |
| E88 | Same as Example 1 | G(M)G(M)G(M)A(M)G(M)A(M)AUACAAGCUACUUGUUCUUUUUGCAGCCACCAUGG(F)ACU(F)ACA(F)AG(M)G(F)ACG(F)ACG(F)ACG(F)ACA(F)AG(M)A(F)UCA(F)UCG(F)ACU(F)AUA(F)AAGACGACG(F)ACG(F)AUA(F)AAG(F)GUG(F)GCG(F)ACU(F)AUA(F)AG(M)G(F)ACG(F)ACG(F)ACG(F)ACA(F)AAC(F)ACC(F)ACC(F)ACC(F)ACC(F)ACC(F)ACU(M)G(M)A(M) | 315 |
| E88 1 | Solid Phase Synthesis | G(M)G(M)G(M)A(M)G(M)A(M)AUACAAGCUACUUGUUCUUUUUGCAGCCACCAUGG(F)ACU(F)ACA(F)AG(M)G(F)ACG(F)ACG(F)ACG(F)ACA(F)AG(M)A(F)UCA(F)UCG(F)ACU(F)AUA(F)AAG | 316 |
| E88-2 | Solid Phase Synthesis | pACGACG(F)ACG(F)AUA(F)AAG(F)GUG(F)GCG(F)ACU(F)AUA(F)AG(M)G(F)ACG(F)ACG(F)ACG(F)ACA(F)AAC(F)ACC(F)ACC(F)ACC(F)ACC(F)ACC(F)ACU(M)G(M)A(M) | 317 |
| E89 | Same as Example 1 | G(M)G(M)G(M)A(M)G(M)A(M)AUACAAGCUACUUGUUCUUUUUGCAGCCACCAUGGACUACA(F)AG(M)GACGACGACGACA(F)AG(M)AUCAUCGACUAUAAAGACGACGACGAUAAAGGUGGCGACUAUA(F)AG(M)GACGACGACGACAAACACCACCACCACCACCACU(M)G(M)A(M) | 318 |
| E89-1 | Solid Phase Synthesis | G(M)G(M)G(M)A(M)G(M)A(M)AUACAAGCUACUUGUUCUUUUUGCAGCCACCAUGGACUACA(F)AG(M)GACGACGACGACA(F)AG(M)AUCAUCGACUAUAAAG | 319 |
| E89-2 | Solid Phase Synthesis | pACGACGACGAUAAAGGUGGCGACUAUA(F)AG(M)GACGACGACGACAAACACCACCACCACCACCACU(M)G(M)A(M) | 320 |

TABLE 40

| | | | |
|---|---|---|---|
| E90 | Same as Example 1 | G(M)G(M)G(M)A(M)G(M)A(M)AUACAAGCUACUUGUUCUUUUUGCAGCCACCAUGGACUACA(F)AGGACGACGACGACA(F)AGAUCAUCGACUAUAAAGACGACGACGAUAAAGGUGGCGACUAUA(F)AGGACGACGACGACAAACACCACCACCACCACCACU(M)G(M)A(M) | 321 |
| E90-1 | Solid Phase Synthesis | G(M)G(M)G(M)A(M)G(M)A(M)AUACAAGCUACUUGUUCUUUUUGCAGCCACCAUGGACUACA(F)AGGACGACGACGACA(F)AGAUCAUCGACUAUAAAG | 322 |
| E90-2 | Solid Phase Synthesis | pACGACGACGAUAAAGGUGGCGACUAUA(F)AGGACGACGACGACAAACACCACCACCACCACCACU(M)G(M)A(M) | 323 |
| E91 | Same as Example 1 | G(M)G(M)G(M)A(M)G(M)A(M)AUACAAGCUACUUGUUCUUUUUGCAGCCACCAUGG(F)AC(M)UACAAGGACGACGACG(F)AC(M)AAGAUCAUCG(F)AC(M)UAUAAAGACGACG(F)AC(M)GAUAAAGGUGGCG(F)AC(M)UAUAAGGACGACGACG(F)AC(M)AAACACCACCACCACCACCACU(M)G(M)A(M) | 324 |
| E91-1 | Solid Phase Synthesis | G(M)G(M)G(M)A(M)G(M)A(M)AUACAAGCUACUUGUUCUUUUUGCAGCCACCAUGG(F)AC(M)UACAAGGACGACGACG(F)AC(M)AAGAUCAUCG(F)AC(M)UAUAAAG | 325 |
| E91-2 | Solid Phase Synthesis | pACGACG(F)AC(M)GAUAAAGGUGGCG(F)AC(M)UAUAAGGACGACGACG(F)AC(M)AAACACCACCACCACCACCACU(M)G(M)A(M) | 326 |
| E92 | Same as Example 1 | G(M)G(M)G(M)A(M)G(M)A(M)AUACAAGCUACUUGUUCUUUUUGCAGCCACCAUGGACUACAAGGACGACGACGACAAGAUCAUCGACU(F)AU(M)AAAGACGACGACG(F)AU(M)AAAG(F)GU(M)GGCGACU(F)AU(M)AAGGACGACGACGACAAACACCACCACCACCACCACU(M)G(M)A(M) | 327 |
| E92-1 | Solid Phase Synthesis | G(M)G(M)G(M)A(M)G(M)A(M)AUACAAGCUACUUGUUCUUUUUGCAGCCACCAUGGACUACAAGGACGACGACGACAAGAUCAUCGACU(F)AU(M)AAAG | 328 |
| E92-2 | Solid Phase Synthesis | pACGACGACG(F)AU(M)AAAG(F)GU(M)GGCGACU(F)AU(M)AAGGACGACGACGACAAACACCACCACCACCACCACU(M)G(M)A(M) | 329 |
| E93 | Same as Example 1 | G(M)G(M)G(M)A(M)G(M)A(M)AUACAAGCUACUUGUUCUUUUUGCAGCCACCAUGGACUACAAGGACGACGACGACAAGAUCAUCGACU(F)AU(M)AAAGACGACGACGAUAAAG(F)GU(M)GGCGACU(F)AU(M)AAGGACGACGACGACAAACACCACCACCACCACCACU(M)G(M)A(M) | 330 |
| E93-1 | Solid Phase Synthesis | G(M)G(M)G(M)A(M)G(M)A(M)AUACAAGCUACUUGUUCUUUUUGCAGCCACCAUGGACUACAAGGACGACGACGACAAGAUCAUCGACU(F)AU(M)AAAG | 331 |
| E93-2 | Solid Phase Synthesis | pACGACGACGAUAAAG(F)GU(M)GGCGACU(F)AU(M)AAGGACGACGACGACAAACACCACCACCACCACCACU(M)G(M)A(M) | 332 |

TABLE 40-continued

| | | | |
|---|---|---|---|
| E94 | Same as Example 1 | G(M)G(M)G(M)A(M)G(M)A(M)AUACAAGCUACUUGUUCUUUUUGCAGCCACC AUGG(M)ACUACAAGGACGACGACG(M)ACAAGAUCAUCG(M)ACUAUAAAGA CGACG(M)ACGAUAAAGGUGGCG(M)ACUAUAAGGACGACGACG(M)ACAAAC ACCACCACCACCACCACU(M)G(M)A(M) | 333 |
| E94-1 | Solid Phase Synthesis | G(M)G(M)G(M)A(M)G(M)A(M)AUACAAGCUACUUGUUCUUUUUGCAGCCACC AUGG(M)ACUACAAGGACGACGACG(M)ACAAGAUCAUCG(M)ACUAUAAAG | 334 |
| E94-2 | Solid Phase Synthesis | pACGACG(M)ACGAUAAAGGUGGCG(M)ACUAUAAGGACGACGACG(M)ACAA ACACCACCACCACCACCACU(M)G(M)A(M) | 335 |

TABLE 41

| | | | |
|---|---|---|---|
| E95 | Same as Example 1 | G(M)G(M)G(M)A(M)G(M)A(M)AUACAAGCUACUUGUUCUUUUUGCAGCCACC AUGGACUACAAGG(M)ACG(M)ACG(M)ACGACAAGAUCAUCGACUAUAAAGA CGACGACGAUAAAGGUGGCGACUAUAAGG(M)ACG(M)ACG(M)ACGACAAAC ACCACCACCACCACCACU(M)G(M)A(M) | 336 |
| E95-1 | Solid Phase Synthesis | G(M)G(M)G(M)A(M)G(M)A(M)AUACAAGCUACUUGUUCUUUUUGCAGCCACC AUGGACUACAAGG(M)ACG(M)ACG(M)ACGACAAGAUCAUCGACUAUAAAG | 337 |
| E95-2 | Solid Phase Synthesis | pACGACGACGAUAAAGGUGGCGACUAUAAGG(M)ACG(M)ACG(M)ACGACAA ACACCACCACCACCACCACU(M)G(M)A(M) | 338 |
| E96 | Same as Example 1 | G(M)G(M)G(M)A(M)G(M)A(M)AUACAAGCUACUUGUUCUUUUUGCAGCCACC AUGG(L)ACUACAAGGACGACGACG(L)ACAAGAUCAUCG(LACUAUAAAGAC GACG(L)ACGAUAAAGGUGGCG(L)ACUAUAAGGACGACGACG(L)ACAAACA CCACCACCACCACCACU(M)G(M)A(M) | 339 |
| E96-1 | Solid Phase Synthesis | G(M)G(M)G(M)A(M)G(M)A(M)AUACAAGCUACUUGUUCUUUUUGCAGCCACC AUGG(L)ACUACAAGGACGACGACG(L)ACAAGAUCAUCG(L)ACUAUAAAG | 340 |
| E96-2 | Solid Phase Synthesis | pACGACG(L)ACGAUAAAGGUGGCG(LACUAUAAGGACGACGACG(L)ACAAA CACCACCACCACCACCACU(M)G(M)A(M) | 341 |
| E97 | Same as Example 1 | G(F)G(M)G(F)A(M)G(F)A(M)AUACAAGCUACUUGUUCUUUUUGCAGCCACCA UGGACUACAAGGACGACGACGACAAGAUCAUCGACUAUAAAGACGACGAC GAUAAAGGUGGCGACUAUAAGGACGACGACGACAAACACCACCACCACCA CCACU(M)G(F)A(M) | 342 |
| E97-1 | Solid Phase Synthesis | G(F)G(M)G(F)A(M)G(F)A(M)AUACAAGCUACUUGUUCUUUUUGCAGCCACCA UGGACUACAAGGACGACGACGACAAGAUCAUCGACUAUAAAG | 343 |
| E97-2 | Solid Phase Synthesis | pACGACGACGAUAAAGGUGGCGACUAUAAGGACGACGACGACAAACACCA CCACCACCACCACU(M)G(F)A(M) | 344 |
| E98 | Same as Example 1 | G(F)^G(M)^G(F)^A(M)^G(F)A(M)AUACAAGCUACUUGUUCUUUUUGCAGCCA CCAUGGACUACAAGGACGACGACGACAAGAUCAUCGACUAUAAAGACGAC GACGAUAAAGGUGGCGACUAUAAGGACGACGACGACAAACACCACCACCA CCACCACU(M)^G(F)^A(M) | 345 |
| E98 1 | Solid Phase Synthesis | G(F)^G(M)^G(F)^A(M)^G(F)A(M)AUACAAGCUACUUGUUCUUUUUGC AGCCACCAUGGACUACAAGGACGACGACGACAAGAUCAUCGACUAUAAAG | 346 |
| E98-2 | Solid Phase Synthesis | pACGACGACGAUAAAGGUGGCGACUAUAAGGACGACGACGACAAACACCA CCACCACCACCACU(M)^G(F)^A(M) | 347 |

TABLE 42

| | | | |
|---|---|---|---|
| E99 | Same as Example 1 | G(B)G(B)G(B)A(B)G(B)A(B)AUACAAGCUACUUGUUCUUUUUGCAGCCACCA UGG(F)ACU(F)ACA(F)AGG(F)ACG(F)ACG(F)ACG(F)ACA(F)AGA(F)UCA(F)U CG(F)ACU(F)AUA(F)AAGACGACG(F)ACG(F)AUA(F)AAG(F)GUG(F)GCG(F)A CU(F)AUA(F)AGG(F)ACG(F)ACG(F)ACG(F)ACA(F)AAC(F)ACC(F)ACC(F)ACC (F)ACC(F)ACC(F)ACU(B)G(B)A(B) | 348 |
| E99 1 | Solid Phase Synthesis | G(B)G(B)G(B)A(B)G(B)A(B)AUACAAGCUACUUGUUCUUUUUGCAGCCACCA UGG(F)ACU(F)ACA(F)AGG(F)ACG(F)ACG(F)ACG(F)ACA(F)AGA(F)UCA(F)U CG(F)ACU(F)AUA(F)AAG | 349 |

TABLE 42-continued

| | | | |
|---|---|---|---|
| E99-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(B)G(B)A(B) | 350 |
| E100 | Same as Example 1 | G(M)^G(M)^G(M)^A(M)^G(M)^A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)^G(M)^A(M) | 351 |
| E100-1 | Solid Phase Synthesis | G(M)^G(M)^G(M)^A(M)^G(M)^A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 352 |
| E100-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(M)^G(M)^A(M) | 353 |
| E101 | Same as Example 1 | G(M)G(M)G(M)A(M)G(M)C(M)CACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACG(F)AUA(F)AAG(F)GUG(F)GCG(F)ACU(F)AUA(F)AGG(F)ACG(F)ACG(F)ACG(F)ACAAAGCCA(F)UUA(F)AUA(F)GUG(F)ACU(F)CUG(F)AGU(F)GUC(F)CCC(F)UGU(F)CCC(F)ACG(F)ACG(F)GGU(F)ACU(F)GCC(F)UCC(F)ACG(F)ACG(F)GUG(F)UGU(F)GCA(F)UGU(F)AUA(F)UUG(F)AAG(F)CAUUGGACA(F)AGU(F)ACG(F)CCU(F)GCA(F)ACU(F)GUG(F)UUG(F)UUG(F)GCU(F)ACA(F)UCG(F)GGG(F)AGC(F)GCU(F)GUC(F)AGU(F)ACC(F)GAG(F)ACC(F)UGA(F)AGU(F)GGU(F)GGG(F)AAC(F)UGC(F)GCU(M)G(M)A(M) | 354 |
| E101-1 | Solid Phase Synthesis | G(M)G(M)G(M)A(M)G(M)C(M)CACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACG(F)AUA(F)AAG(F)GUG(F)GCG(F)ACU(F)AUA(F)AGG(F)ACG(F)ACG(F)ACG(F)AC | 355 |
| E101-2 | Solid Phase Synthesis | pAAAGCCA(F)UUA(F)AUA(F)GUG(F)ACU(F)CUG(F)AGU(F)GUC(F)CCC(F)UGU(F)CCC(F)ACG(F)ACG(F)GGU(F)ACU(F)GCC(F)UCC(F)ACG(F)ACG(F)GUG(F)UGU(F)GCA(F)UGU(F)AUA(F)UUG(F)AAG(F)CAU | 356 |
| E101-3 | Solid Phase Synthesis | pUGGACA(F)AGU(F)ACG(F)CCU(F)GCA(F)ACU(F)GUG(F)UUG(F)UUG(F)GCU(F)ACA(F)UCG(F)GGG(F)AGC(F)GCU(F)GUC(F)AGU(F)ACC(F)GAG(F)ACC(F)UGA(F)AGU(F)GGU(F)GGG(F)AAC(F)UGC(F)GCU(M)G(M)A(M) | 357 |

TABLE 43

| | | | |
|---|---|---|---|
| E102 | Same as Example 1 | G(MOE)^G(MOE)^G(MOE)A(MOE)G(MOE)C(MOE)CACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACG(F)AUA(F)AAG(F)GUG(F)GCG(F)ACU(F)AUA(F)AGG(F)ACG(F)ACG(F)ACG(F)ACAAAGCCA(F)UUA(F)AUA(F)GUG(F)ACU(F)CUG(F)AGU(F)GUC(F)CCC(F)UGU(F)CCC(F)ACG(F)ACG(F)GGU(F)ACU(F)GCC(F)UCC(F)ACG(F)ACG(F)GUG(F)UGU(F)GCA(F)UGU(F)AUA(F)UUG(F)AAG(F)CAUUGGACA(F)AGU(F)ACG(F)CCU(F)GCA(F)ACU(F)GUG(F)UUG(F)UUG(F)GCU(F)ACA(F)UCG(F)GGG(F)AGC(F)GCU(F)GUC(F)AGU(F)ACC(F)GAG(F)ACC(F)UGA(F)AGU(F)GGU(F)GGG(F)AAC(F)UGC(F)GCU(MOE)^(G(MOE)^A(MOE) | 358 |
| E102-1 | Solid Phase Synthesis | G(MOE)^G(MOE)^G(MOE)A(MOE)G(MOE)C(MOE)CACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACG(F)AUA(F)AAG(F)GUG(F)GCG(F)ACU(F)AUA(F)AGG(F)ACG(F)ACG(F)ACG(F)AC | 359 |
| E102-2 | Solid Phase Synthesis | pAAAGCCA(F)UUA(F)AUA(F)GUG(F)ACU(F)CUG(F)AGU(F)GUC(F)CCC(F)UGU(F)CCC(F)ACG(F)ACG(F)GGU(F)ACU(F)GCC(F)UCC(F)ACG(F)ACG(F)GUG(F)UGU(F)GCA(F)UGU(F)AUA(F)UUG(F)AAG(F)CAU | 360 |
| E102-3 | Solid Phase Synthesis | pUGGACA(F)AGU(F)ACG(F)CCU(F)GCA(F)ACU(F)GUG(F)UUG(F)UUG(F)GCU(F)ACA(F)UCG(F)GGG(F)AGC(F)GCU(F)GUC(F)AGU(F)ACC(F)GAG(F)ACC(F)UGA(F)AGU(F)GGU(F)GGG(F)AAC(F)UGC(F)GCU(MOE)^G(MOE)^A(MOE) | 361 |
| E103 | Same as Example 1 | G(F)^G(M)^G(F)A(M)G(F)C(M)CACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACG(F)AUA(F)AAG(F)GUG(F)GCG(F)ACU(F)AUA(F)AGG(F)ACG(F)ACG(F)ACG(F)ACAAAGCCA(F)UUA(F)AUA(F)GUG(F)ACU(F)CUG(F)AGU(F)GUC(F)CCC(F)UGU(F)CCC(F)ACG(F)ACG(F)GGU(F)ACU(F)GCC(F)UCC(F)ACG(F)ACG(F)GUG(F)UGU(F)GCA(F)UGU(F)AUA(F)UUG(F)AAG(F)CAUUGGACA(F)A | 362 |

TABLE 43-continued

| | | | |
|---|---|---|---|
| | | GU(F)ACG(F)CCU(F)GCA(F)ACU(F)GUG(F)UUG(F)UUG(F)GCU(F)ACACF)UC G(F)GGG(F)AGC(F)GCU(F)GUC(F)AGU(F)ACC(F)GAG(F)ACC(F)UGA(F)AGUG F)GGU(F)GGG(F)AAC(F)UGC(F)GCU(M)^G(F)^A(M) | |
| E103-1 | Solid Phase Synthesis | G(F)^G(M)^G(F)A(M)G(F)C(M)CACCAUGG(F)ACU(F)ACA(F)AGG(F)ACG(F)A CG(F)ACG(F)ACA(F)AGA(F)UCA(F)UCG(F)ACU(F)AUA(F)AAG(F)ACG(F)ACG (F)ACG(F)AUA(F)AAG(F)GUG(F)GCG(F)ACU(F)AUA(F)AGG(F)ACG(F)ACG(F) ACG(F)AC | 363 |
| E103-2 | Solid Phase Synthesis | pAAAGCCA(F)UUA(F)AUA(F)GUG(F)ACU(F)CUG(F)AGU(F)GUC(F)CCC(F)UG U(F)CCC(F)ACG(F)ACG(F)GGU(F)ACU(F)GCC(F)UCC(F)ACG(F)ACG(F)GUG (F)UGU(F)GCA(F)UGU(F)AUA(F)UUG(F)AAG(F)CAU | 364 |
| E103-3 | Solid Phase Synthesis | pUGGACA(F)AGU(F)ACG(F)CCU(F)GCA(F)ACU(F)GUG(F)UUG(F)UUG(F)GC U(F)ACA(F)UCG(F)GGG(F)AGC(F)GCU(F)GUC(F)AGU(F)ACC(F)GAG(F)ACC (F)UGA(F)AGU(F)GGU(F)GGG(F)AAC(F)UGC(F)GCU(M)^G(F)^A(M) | 365 |

TABLE 44

| | | | |
|---|---|---|---|
| E104 | Same as Example 1 | G(MOE)G(MOE)G(MOE)A(MOE)G(MOE)C(MOE)CACCAUGG(F)ACU(F)ACA(F) AGG(F)ACG(F)ACG(F)ACG(F)ACA(F)AGA(F)UCA(F)UCG(F)ACU(F)AUA(F)AA G(F)ACG(F)ACG(F)ACG(F)AUA(F)AAG(F)GUG(F)GCG(F)ACU(F)AUA(F)AGG (F)ACG(F)ACG(F)ACG(F)ACAAAGCCA(F)UUA(F)AUA(F)GUG(F)ACU(F)CUG(F) AGU(F)GUC(F)CCC(F)UGU(F)CCC(F)ACG(F)ACG(F)GGU(F)ACU(F)GCC(F)U CC(F)ACG(F)ACG(F)GUG(F)UGU(F)GCA(F)UGU(F)AUA(F)UUG(F)AAG(F)CA UUGGACA(F)AGU(F)ACG(F)CCU(F)GCA(F)ACU(F)GUG(F)UUG(F)UUG(F)GC U(F)ACA(F)UCG(F)GGG(F)AGC(F)GCU(F)GUC(F)AGU(F)ACC(F)GAG(F)ACC (F)UGA(F)AGU(F)GGU(F)GGG(F)AAC(F)UGC(F)GCU(MOE)G(MOE)A(MOE) | 366 |
| E104-1 | Solid Phase Synthesis | G(MOE)G(MOE)G(MOE)A(MOE)G(MOE)C(MOE)CACCAUGG(F)ACU(F)ACACF) AGG(F)ACG(F)ACG(F)ACG(F)ACA(F)AGA(F)UCA(F)UCG(F)ACU(F)AUA(F)AA G(F)ACG(F)ACG(F)ACG(F)AUA(F)AAG(F)GUG(F)GCG(F)ACU(F)AUA(F)AGG (F)ACG(F)ACG(F)ACG(F)AC | 367 |
| E104-2 | Solid Phase Synthesis | pAAAGCCA(F)UUA(F)AUA(F)GUG(F)ACU(F)CUG(F)AGU(F)GUC(F)CCC(F)UG U(F)CCC(F)ACG(F)ACG(F)GGU(F)ACU(F)GCC(F)UCC(F)ACG(F)ACG(F)GUG (F)UGU(F)GCA(F)UGU(F)AUA(F)UUG(F)AAG(F)CAU | 368 |
| E104-3 | Solid Phase Synthesis | pUGGACA(F)AGU(F)ACG(F)CCU(F)GCA(F)ACU(F)GUG(F)UUG(F)UUG(F)GC U(F)ACA(F)UCG(F)GGG(F)AGC(F)GCU(F)GUC(F)AGU(F)ACC(F)GAG(F)ACC (F)UGA(F)AGU(F)GGU(F)GGG(F)AAC(F)UGC(F)GCU(MOE)G(MOE)A(MOE) | 369 |
| E105 | Same as Example 1 | G(F)G(M)G(F)A(M)G(F)C(M)CACCAUGG(F)ACU(F)ACA(F)AGG(F)ACG(F)ACG (F)ACG(F)ACA(F)AGA(F)UCA(F)UCG(F)ACU(F)AUA(F)AAG(F)ACG(F)ACG(F) ACG(F)AUA(F)AAG(F)GUG(F)GCG(F)ACU(F)AUA(F)AGG(F)ACG(F)ACG(F)A CG(F)ACAAAGCCA(F)UUA(F)AUA(F)GUG(F)ACU(F)CUG(F)AGU(F)GUC(F)C CC(F)UGU(F)CCC(F)ACG(F)ACG(F)GGU(F)ACU(F)GCC(F)UCC(F)ACG(F)AC G(F)GUG(F)UGU(F)GCA(F)UGU(F)AUA(F)UUG(F)AAG(F)CAUUGGACA(F)AG U(F)ACG(F)CCU(F)GCA(F)ACU(F)GUG(F)UUG(F)UUG(F)GCU(F)ACA(F)UCG (F)GGG(F)AGC(F)GCU(F)GUC(F)AGU(F)ACC(F)GAG(F)ACC(F)UGA(F)AGU(F) GGU(F)GGG(F)AAC(F)UGC(F)GCU(M)G(F)A(M) | 370 |
| E105-1 | Solid Phase Synthesis | G(F)G(M)G(F)A(M)G(F)C(M)CACCAUGG(F)ACU(F)ACA(F)AGG(F)ACG(F)ACG (F)ACG(F)ACA(F)AGA(F)UCA(F)UCG(F)ACU(F)AUA(F)AAG(F)ACG(F)ACG(F) ACG(F)AUA(F)AAG(F)GUG(F)GCG(F)ACU(F)AUA(F)AGG(F)ACG(F)ACG(F)A OG(F)AC | 371 |
| E105-2 | Solid Phase Synthesis | pAAAGCCA(F)UUA(F)AUA(F)GUG(F)ACU(F)CUG(F)AGU(F)GUC(F)CCC(F)UG U(F)CCC(F)ACG(F)ACG(F)GGU(F)ACU(F)GCC(F)UCC(F)ACG(F)ACG(F)GUG (F)UGU(F)GCA(F)UGU(F)AUA(F)UUG(F)AAG(F)CAU | 372 |
| E105-3 | Solid Phase Synthesis | pUGGACA(F)AGU(F)ACG(F)CCU(F)GCA(F)ACU(F)GUG(F)UUG(F)UUG(F)GC U(F)ACA(F)UCG(F)GGG(F)AGC(F)GCU(F)GUC(F)AGU(F)ACC(F)GAG(F)ACC (F)UGA(F)AGU(F)GGU(F)GGG(F)AAC(F)UGC(F)GCU(M)G(F)A(M) | 373 |

TABLE 45

| | | | |
|---|---|---|---|
| E106 | Same as Example 1 | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACGAUAAAG(F)GUG(F)GCG(F)ACU(F)AUA(F)AGG(F)ACG(F)ACG(F)ACG(F)ACA(F)AAA(F)GUA(F)UAA(F)UAA(F)ACU(F)UUG(F)AAA(F)AAC(F)UGC(F)ACC(F)ACC(F)ACC(F)ACC(F)ACC(F)ACU(M)G(M)A(M) | 374 |
| E106-1 | Solid Phase Synthesis | G(M)G(M)G(M)A(M)G(M)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACG | 375 |
| E106-2 | Solid Phase Synthesis | pAUAAAG(F)GUG(F)GCG(F)ACU(F)AUA(F)AGG(F)ACG(F)ACG(F)ACG(F)ACA(F)AAA(F)GUA(F)UAA(F)UAA(F)ACU(F)UUG(F)AAA(F)AAC(F)UGC(F)ACC(F)ACC(F)ACC(F)ACC(F)ACC(F)ACU(M)G(M)A(M) | 376 |
| E107 | Same as Example 1 | G(MOE)^G(MOE)^G(MOE)A(MOE)G(MOE)A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACGAUAAAG(F)GUG(F)GCG(F)ACU(F)AUA(F)AGG(F)ACG(F)ACG(F)ACG(F)ACA(F)AAACF)GUA(F)UAA(F)UAA(F)ACU(F)UUG(F)AAA(F)AAC(F)UGC(F)ACC(F)ACC(F)ACC(F)ACC(F)ACC(F)ACU(MOE)^G(MOE)^A(MOE) | 377 |
| E107-1 | Solid Phase Synthesis | G(MOE)^G(MOE)^G(MOE)A(MOE)G(MOE)A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACG | 378 |
| E107-2 | Solid Phase Synthesis | pAUAAAG(F)GUG(F)GCG(F)ACU(F)AUA(F)AGG(F)ACG(F)ACG(F)ACG(F)ACA(F)AAA(F)GUA(F)UAA(F)UAA(F)ACU(F)UUG(F)AAA(F)AAC(F)UGC(F)ACC(F)ACC(F)ACC(F)ACC(F)ACC(F)ACU(MOE)^G(MOE)^A(MOE) | 379 |
| E108 | Same as Example 1 | G(F)^G(M)^G(F)A(M)G(F)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACGAUAAAG(F)GUG(F)GCG(F)ACU(F)AUA(F)AGG(F)ACG(F)ACG(F)ACG(F)ACA(F)AAA(F)GUA(F)UAA(F)UAA(F)ACU(F)UUG(F)AAA(F)AAC(F)UGC(F)ACC(F)ACC(F)ACC(F)ACC(F)ACC(F)ACU(M)^G(F)^A(M) | 380 |
| E108-1 | Solid Phase Synthesis | G(F)^G(M)^G(F)A(M)G(F)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACG | 381 |
| E108-2 | Solid Phase Synthesis | pAUAAAG(F)GUG(F)GCG(F)ACU(F)AUA(F)AGG(F)ACG(F)ACG(F)ACG(F)ACA(F)AAA(F)GUA(F)UAA(F)UAA(F)ACU(F)UUG(F)AAA(F)AAC(F)UGC(F)ACC(F)ACC(F)ACC(F)ACC(F)ACC(F)ACU(M)^G(F)^A(M) | 382 |

TABLE 46

| | | | |
|---|---|---|---|
| E109 | Same as Example 1 | G(F)G(M)G(F)A(M)G(F)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACGAUAAAG(F)GUG(F)GCG(F)ACU(F)AUA(F)AGG(F)ACG(F)ACG(F)ACG(F)ACA(F)AAA(F)GUA(F)UAA(F)UAA(F)ACU(F)UUG(F)AAA(F)AAC(F)UGC(F)ACC(F)ACC(F)ACC(F)ACC(F)ACC(F)ACU(M)G(F)A(M) | 383 |
| E109-1 | Solid Phase Synthesis | G(F)G(M)G(F)A(M)G(F)A(M)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG(F)ACG(F)ACG(F)ACG | 384 |
| E109-2 | Solid Phase Synthesis | pAUAAAG(F)GUG(F)GCG(F)ACU(F)AUA(F)AGG(F)ACG(F)ACG(F)ACG(F)ACA(F)AAA(F)GUA(F)UAA(F)UAA(F)ACU(F)UUG(F)AAA(F)AAC(F)UGC(F)ACC(F)ACC(F)ACC(F)ACC(F)ACC(F)ACU(M)G(F)A(M) | 385 |
| E110 | Same as Example 1 | G(MOE)^G(MOE)^G(MOE)^A(MOE)^G(MOE)^A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAGACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(MOE)^G(MOE)^A(MOE) | 386 |
| E110-1 | Solid Phase Synthesis | G(MOE)^G(MOE)^G(MOE)^A(MOE)^G(MOE)^A(MOE)AUACAAGCUACUUGUUCUUUUUGCAGCCACCAUGG(F)ACU(F)ACA(F)AGG(F)ACG(F)ACG(F)ACG(F)ACA(F)AGA(F)UCA(F)UCG(F)ACU(F)AUA(F)AAG | 387 |
| E110-2 | Solid Phase Synthesis | pACGACG(F)ACG(F)AUA(F)AAG(F)GUG(F)GCG(F)ACU(F)AUA(F)AGG(F)ACG(F)ACG(F)ACG(F)ACA(F)AAC(F)ACC(F)ACC(F)ACC(F)ACC(F)ACC(F)ACU(MOE)^G(MOE)^A(MOE) | 388 |

TABLE 46-continued

| | | | |
|---|---|---|---|
| E111 | Same as Example 1 | BDBDG(M)G(M)G(M)A(M)G(M)A(M)AUACAAGCUACUUGUUCUUUUUGCAGC CACCAUGG(F)ACU(F)ACA(F)AGG(F)ACG(F)ACG(F)ACG(F)ACA(F)AGA(F)U CA(F)UCG(F)ACU(F)AUA(F)AAGACGACG(F)ACG(F)AUA(F)AAG(F)GUG(F)G CG(F)ACU(F)AUA(F)AGG(F)ACG(F)ACG(F)ACG(F)ACA(F)AAC(F)ACC(F)AC C(F)ACC(F)ACC(F)ACC(F)ACU(M)G(M)A(M)AAAAAAAAAAAAAAAAAAAA | 389 |
| E111-1 | Solid Phase Synthesis | BDBDG(M)G(M)G(M)A(M)G(M)A(M)AUACAAGCUACUUGUUCUUUUUGCAGC CACCAUGG(F)ACU(F)ACA(F)AGG(F)ACG(F)ACG(F)ACG(F)ACA(F)AGA(F)U CA(F)UCG(F)ACU(F)AUA(F)AAG | 390 |
| E111-2 | Solid Phase Synthesis | pACGACG(F)ACG(F)AUA(F)AAG(F)GUG(F)GCG(F)ACU(F)AUA(F)AGG(F)AC G(F)ACG(F)ACG(F)ACA(F)AAC(F)ACC(F)ACC(F)ACC(F)ACC(F)ACC(F)ACU (M)G(M)A(M)AAAAAAAAAAAAAAAAAAAA | 391 |
| E112 | Same as Example 1 | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGA CGAUAAAGGUGGCGACUAUAAGGACGACGACGACAAACACCACCACCACC ACCACU(M)G(M)A(M) | 392 |
| E112-1 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAG | 393 |
| E112-2 | Solid Phase Synthesis | pACGACGACGAUAAAGGUGGCGACUAUAAGGACGACGACGACAAACACCA CCACCACCACCACU(M)G(M)A(M) | 394 |

TABLE 47

| | | | |
|---|---|---|---|
| E113 | Same as Example 1 | G(MOE)G(MOE)G(MOE)A(MOE)G(MOE)A(MOE)AUACAAGCUACUUGUUCUUU UUGCAGCCACCAUGG(F)ACU(F)ACA(F)AGG(F)ACG(F)ACG(F)ACG(F)ACA(F) AGA(F)UCA(F)UCG(F)ACU(F)AUA(F)AAGACGACG(F)ACG(F)AUA(F)AAG(F) GUG(F)GCG(F)ACU(F)AUA(F)AGG(F)ACG(F)ACG(F)ACG(F)ACA(F)AAC(F)A CC(F)ACC(F)ACC(F)ACC(F)ACC(F)ACT(MOE)G(MOE)A(MOE)AAAAAAAAAA AAAAAAAAAAAAAAAAAAAAAAAAAAAAAA | 395 |
| E113-1 | Solid Phase Synthesis | G(MOE)G(MOE)G(MOE)A(MOE)G(MOE)A(MOE)AUACAAGCUACUUGUUCUUU UUGCAGCCACCAUGG(F)ACU(F)ACA(F)AGG(F)ACG(F)ACG(F)ACG(F)ACA(F) AGA(F)UCA(F)UCG(F)ACU(F)AUA(F)AAG | 396 |
| E113-2 | Solid Phase Synthesis | pACGACG(F)ACG(F)AUA(F)AAG(F)GUG(F)GCG(F)ACU(F)AUA(F)AGG(F)AC G(F)ACG(F)ACG(F)ACA(F)AAC(F)ACC(F)ACC(F)ACC(F)ACC(F)ACC(F)ACT (MOE)G(MOE)A(MOE)AAAAAAAAAAAAAAAAAAAAAAAAAAAAAAAAAAAAA AAA | 397 |
| E114 | Same as Example 1 | G(MOE)^G(MOE)^G(MOE)A(MOE)G(MOE)A(MOE)AUACAAGCUACUUGUUCU UUUUGCAGCCACCAUGG(F)ACU(F)ACA(F)AGG(F)ACG(F)ACG(F)ACG(F)AC A(F)AGA(F)UCA(F)UCG(F)ACU(F)AUA(F)AAGACGACG(F)ACG(F)AUA(F)AAG (F)GUG(F)GCG(F)ACU(F)AUA(F)AGG(F)ACG(F)ACG(F)ACG(F)ACA(F)AAC(F) ACC(F)ACC(F)ACC(F)ACC(F)ACC(F)ACT(MOE)^G(MOE)^A(MOE)AAAAAAAA AAAAAAAAAAAAAAAAAAAAAAAAAAAAAAAA | 398 |
| E114-1 | Solid Phase Synthesis | G(MOE)^G(MOE)^G(MOE)A(MOE)G(MOE)A(MOE)AUACAAGCUACUUGUUCU UUUUGCAGCCACCAUGG(F)ACU(F)ACA(F)AGG(F)ACG(F)ACG(F)ACG(F)AC A(F)AGA(F)UCA(F)UCG(F)ACU(F)AUA(F)AAG | 399 |
| E114-2 | Solid Phase Synthesis | pACGACG(F)ACG(F)AUA(F)AAG(F)GUG(F)GCG(F)ACU(F)AUA(F)AGG(F)AC G(F)ACG(F)ACG(F)ACA(F)AAC(F)ACC(F)ACC(F)ACC(F)ACC(F)ACC(F)ACT (MOE)^G(MOE)^A(MOE)AAAAAAAAAAAAAAAAAAAAAAAAAAAAAAAAAAAA AAAA | 400 |
| E115 | Solid Phase Synthesis | G(M)G(M)G(M)A(M)G(M)A(M)AUACAAGCUACUUGUUCUUUUUGCAGCCACC AUGGACUACAAGGACGACGACGACAAGAUCAUCGACUAUAAAGACGACGA CGAUAAAGGUGGCGACUAUAAGGaCGACGACGACAAACACCACCACCACC ACCACU(M)G(M)A(M) | 401 |
| E116 | Solid Phase Synthesis | GGGAGAAUACAAGCUACUUGUUCUUUUUGCAGCCACCAUGGACUAUAAGG ACGACGACGACAAAGGUGGCAGCCACCACCACCACCACCACUGA | 402 |
| E117 | Solid Phase Synthesis | GGGAGCCACCAUGGACUAUAAGGACGACGACGACAAAGGUGGCAGCCACC ACCACCACCACCACUGA | 403 |
| E118 | Solid Phase Synthesis | G(MOE)G(MOE)G(MOE)AGCCACCAUGGACUAUAAGGACGACGACGACAAAG GUGGCCACCACCACCACCACCACU(MOE)G(MOE)A(MOE) | 404 |
| E119 | Solid Phase Synthesis | G(MOE)G(MOE)G(MOE)A(MOE)G(MOE)A(MOE)A(MOE)UACAAGCUACUUGU UCUUUUUGCAGCCACCAUGGACUAUAAGGACGACGACGACAAAGGUGGCA GCCACCACCACCACCACCACU(MOE)G(MOE)A(MOE) | 405 |

TABLE 47-continued

| | | | |
|---|---|---|---|
| E120 | Solid Phase Synthesis | G(MOE)G(MOE)G(MOE)AGCCACCAUGGACUAUAAGGACGACGACGACAAAG GUGGCAGCCACCACCACCACCACCACU(MOE)G(MOE)A(MOE) | 406 |
| E121 | Solid Phase Synthesis | G(MOE)G(MOE)G(MOE)A(MOE)G(MOE)A(MOE)AUACAAGCUACUUGUUCUUU UUGCAGCCACCA(F)UGG(F)ACU(F)AUA(F)AGG(F)ACG(F)ACG(F)ACG(F)AC A(F)AAG(F)GUG(F)GCC(F)ACC(F)ACC(F)ACC(F)ACC(F)ACC(F)ACU(MOE)G (MOE)A(MOE) | 407 |

TABLE 48

| | | | |
|---|---|---|---|
| E122 | Solid Phase Synthesis | G(MOE)G(MOE)G(MOE)AGCCACCA(F)UGG(F)ACU(F)AUA(F)AAG(F)ACG(F)A CG(F)ACG(F)AUA(F)AAG(F)GUG(F)GCG(F)ACU(F)AUA(F)AGG(F)ACG(F)AC G(F)ACG(F)ACA(F)AAC(F)ACC(F)ACC(F)ACC(F)ACC(F)ACC(F)ACU(MOE)G (MOE)A(MOE) | 408 |
| E123 | Solid Phase Synthesis | G(MOE)G(MOE)G(MOE)AGCCACCACF)UGG(F)ACU(F)AUA(F)AGG(F)ACG(F)A CG(F)ACG(F)ACA(F)AAG(F)GUG(F)GCC(F)ACC(F)ACC(F)ACC(F)ACC(F)AC C(F)ACU(MOE)G(MOE)A(MOE) | 409 |
| E124 | Solid Phase Synthesis | G(MOE)G(MOE)G(MOE)A(MOE)G(MOE)A(MOE)A(MOE)UACAAGCUACUUGU UCUUUUUGCAGCCACCA(F)UGG(F)ACU(F)AUA(F)AGG(F)ACG(F)ACG(F)AC G(F)ACA(F)AAG(F)GUG(F)GCA(F)GCC(F)ACC(F)ACC(F)ACC(F)ACC(F)ACC (F)ACU(MOE)G(MOE)A(MOE) | 410 |
| E125 | Solid Phase Synthesis | G(MOE)G(MOE)G(MOE)AGCCACCA(F)UGG(F)ACU(F)AUA(F)AGG(F)ACG(F)A CG(F)ACG(F)ACA(F)AAG(F)GUG(F)GCA(F)GCC(F)ACC(F)ACC(F)ACC(F)AC C(F)ACC(F)ACU(MOE)G(MOE)A(MOE) | 411 |
| E126 | Solid Phase Synthesis | G(MOE)G(MOE)G(MOE)A(MOE)G(MOE)A(MOE)AUACAAGCUACUUGUUCUUU UUGCAGCCACCAUGG(F)ACU(F)AUA(F)AGG(F)ACG(F)ACG(F)ACG(F)ACA(F) AAG(F)GUG(F)GCC(F)ACC(F)ACC(F)ACC(F)ACC(F)ACC(F)ACU(MOE)G(MOE) A(MOE) | 412 |
| E127 | Solid Phase Synthesis | G(MOE)G(MOE)G(MOE)AGCCACCA(F)UGGACUAUAAAGACGACGACGAUAA AGGUGGCGACUAUAAGGACGACGACGACAAACACCACCACCACCACCACT (MOE)G(MOE)A(MOE) | 413 |
| E128 | Solid Phase Synthesis | G(MOE)G(MOE)G(MOE)AGCCACCA(F)UG(F)GACUAUAAAGACGACGACGAU AAAGGUGGCGACUAUAAGGACGACGACGACAAACACCACCACCACCACCA CT(MOE)G(MOE)A(MOE) | 414 |
| E129 | Solid Phase Synthesis | G(MOE)G(MOE)G(MOE)AGCCACCA(F)UG(M)GACUAUAAAGACGACGACGAU AAAGGUGGCGACUAUAAGGACGACGACGACAAACACCACCACCACCACCA CT(MOE)G(MOE)A(MOE) | 415 |
| E130 | Solid Phase Synthesis | G(MOE)G(MOE)G(MOE)AGCCACCA(F)UgGACUAUAAAGACGACGACGAUAA AGGUGGCGACUAUAAGGACGACGACGACAAACACCACCACCACCACCACT (MOE)G(MOE)A(MOE) | 416 |
| E131 | Solid Phase Synthesis | G(MOE)G(MOE)G(MOE)AGCCACCA(F)U(F)GGACUAUAAAGACGACGACGAU AAAGGUGGCGACUAUAAGGACGACGACGACAAACACCACCACCACCACCA CT(MOE)G(MOE)A(MOE) | 417 |
| E132 | Solid Phase Synthesis | G(MOE)G(MOE)G(MOE)AGCCACCA(F)U(F)G(F)GACUAUAAAGACGACGACG AUAAAGGUGGCGACUAUAAGGACGACGACGACAAACACCACCACCACCAC CACT(MOE)G(MOE)A(MOE) | 418 |
| E133 | Solid Phase Synthesis | G(MOE)G(MOE)G(MOE)AGCCACCA(F)U(F)G(M)GACUAUAAAGACGACGACG AUAAAGGUGGCGACUAUAAGGACGACGACGACAAACACCACCACCACCAC CACT(MOE)G(MOE)A(MOE) | 419 |
| E134 | Solid Phase Synthesis | G(MOE)G(MOE)G(MOE)AGCCACCA(F)U(F)gGACUAUAAAGACGACGACGAU AAAGGUGGCGACUAUAAGGACGACGACGACAAACACCACCACCACCACCA CT(MOE)G(MOE)A(MOE) | 420 |
| E135 | Solid Phase Synthesis | G(MOE)G(MOE)G(MOE)AGCCACCA(F)tGGACUAUAAAGACGACGACGAUAA AGGUGGCGACUAUAAGGACGACGACGACAAACACCACCACCACCACCACT (MOE)G(MOE)A(MOE) | 421 |

TABLE 49

| | | | |
|---|---|---|---|
| E136 | Solid Phase Synthesis | G(MOE)G(MOE)G(MOE)AGCCACCA(F)tG(F)GACUAUAAAGACGACGACGAU AAAGGUGGCGACUAUAAGGACGACGACGACAAACACCACCACCACCACCA CT(MOE)G(MOE)A(MOE) | 422 |

TABLE 49-continued

| | | | |
|---|---|---|---|
| E137 | Solid Phase Synthesis | G(MOE)G(MOE)G(MOE)AGCCACCA(F)tG(M)GACUAUAAAGACGACGACGAUAAAGGUGGCGACUAUAAGGACGACGACGACAAACACCACCACCACCACCACT(MOE)G(MOE)A(MOE) | 423 |
| E138 | Solid Phase Synthesis | G(MOE)G(MOE)G(MOE)AGCCACCA(F)tgGACUAUAAAGACGACGACGAUAAAGGUGGCGACUAUAAGGACGACGACGACAAACACCACCACCACCACCACT(MOE)G(MOE)A(MOE) | 424 |
| E139 | Solid Phase Synthesis | G(MOE)G(MOE)G(MOE)AGCCACCAUGGACUAUAAAGACGACGACGAUAAAGGCGGCGACUAUAAGGACGACGACGACAAACACCACCACCACCACCACT(MOE)G(MOE)A(MOE) | 425 |
| E140 | Solid Phase Synthesis | G(MOE)G(MOE)G(MOE)AGCCACCAUGGACUAUAAAGACGACGACGAUAAAG(F)GCG(F)GCGACUAUAAGGACGACGACGACAAACACCACCACCACCACCACT(MOE)G(MOE)A(MOE) | 426 |
| E141 | Solid Phase Synthesis | G(MOE)G(MOE)G(MOE)AGCCACCAUGGACUAUAAAGACGACGACGAUAAAG(F)GC(F)G(F)GC(F)GACUAUAAGGACGACGACGACAAACACCACCACCACCACCACT(MOE)G(MOE)A(MOE) | 427 |
| E142 | Solid Phase Synthesis | G(MOE)G(MOE)G(MOE)AGCCACCAUGGACUAUAAAGACGACGACGAUAAAG(F)GC(M)G(F)GC(M)GACUAUAAGGACGACGACGACAAACACCACCACCACCACCACT(MOE)G(MOE)A(MOE) | 428 |
| E143 | Solid Phase Synthesis | G(MOE)G(MOE)G(MOE)AGCCACCAUGGACUAUAAAGACGACGACGAUAAAG(F)GgG(F)GgGACUAUAAGGACGACGACGACAAACACCACCACCACCACCACT(MOE)G(MOE)A(MOE) | 429 |
| E144 | Solid Phase Synthesis | G(MOE)G(MOE)G(MOE)AGCCACCAUGGACUAUAAAGACGACGACGAUAAAG(F)G(F)CG(F)G(F)CGACUAUAAGGACGACGACGACAAACACCACCACCACCACCACT(MOE)G(MOE)A(MOE) | 430 |
| E145 | Solid Phase Synthesis | G(MOE)G(MOE)G(MOE)AGCCACCAUGGACUAUAAAGACGACGACGAUAAAG(F)G(F)C(F)G(F)G(F)C(F)GACUAUAAGGACGACGACGACAAACACCACCACCACCACCACT(MOE)G(MOE)A(MOE) | 431 |
| E146 | Solid Phase Synthesis | G(MOE)G(MOE)G(MOE)AGCCACCAUGGACUAUAAAGACGACGACGAUAAAG(F)gCG(F)gCGACUAUAAGGACGACGACGACAAACACCACCACCACCACCACT(MOE)G(MOE)A(MOE) | 432 |
| E147 | Solid Phase Synthesis | G(MOE)G(MOE)G(MOE)AGCCACCAUGGACUAUAAAGACGACGACGAUAAAGGUGGUGACUAUAAGGACGACGACGACAAACACCACCACCACCACCACT(MOE)G(MOE)A(MOE) | 433 |
| E148 | Solid Phase Synthesis | G(MOE)G(MOE)G(MOE)AGCCACCAUGGACUAUAAAGACGACGACGAUAAAG(F)GUG(F)GUGACUAUAAGGACGACGACGACAAACACCACCACCACCACCACT(MOE)G(MOE)A(MOE) | 434 |
| E149 | Solid Phase Synthesis | G(MOE)G(MOE)G(MOE)AGCCACCAUGGACUAUAAAGACGACGACGAUAAAG(F)GU(M)G(F)GU(M)GACUAUAAGGACGACGACGACAAACACCACCACCACCACCACT(MOE)G(MOE)A(MOE) | 435 |
| E150 | Solid Phase Synthesis | G(MOE)G(MOE)G(MOE)AGCCACCAUGGACUAUAAAGACGACGACGAUAAAG(F)GT(L)G(F)GT(L)GACUAUAAGGACGACGACGACAAACACCACCACCACCACCACT(MOE)G(MOE)A(MOE) | 436 |

TABLE 50

| | | | |
|---|---|---|---|
| E151 | Solid Phase Synthesis | G(MOE)G(MOE)G(MOE)AGCCACCAUGGACUAUAAAGACGACGACGAUAAAG(F)G(F)UG(F)G(F)UGACUAUAAGGACGACGACGACAAACACCACCACCACCACCACT(MOE)G(MOE)A(MOE) | 437 |
| E152 | Solid Phase Synthesis | G(MOE)G(MOE)G(MOE)AGCCACCAUGGACUAUAAAGACGACGACGAUAAAG(F)G(F)U(M)G(F)G(F)U(M)GACUAUAAGGACGACGACGACAAACACCACCACCACCACCACT(MOE)G(MOE)A(MOE) | 438 |
| E153 | Solid Phase Synthesis | G(MOE)G(MOE)G(MOE)AGCCACCAUGGACUAUAAAGACGACGACGAUAAAG(F)gUG(F)gUGACUAUAAGGACGACGACGACAAACACCACCACCACCACCACT(MOE)G(MOE)A(MOE) | 439 |
| E154 | Solid Phase Synthesis | G(MOE)G(MOE)G(MOE)AGCCACCAUGGACUAUAAAGACGACGACGAUAAAGGUGGCGACUAUAAGGACGACGACGACAAAC(F)ACC(F)ACC(F)ACC(F)ACC(F)ACC(F)ACT(MOE)G(MOE)A(MOE) | 440 |
| E155 | Solid Phase Synthesis | G(MOE)G(MOE)G(MOE)AGCCACCAUGGACUAUAAAGACGACGACGAUAAAGGUGGCGACUAUAAGGACGACGACGACAAACAUCAUCAUCAUCAUCAUT(MOE)G(MOE)A(MOE) | 441 |

TABLE 50-continued

| | | | |
|---|---|---|---|
| E156 | Solid Phase Synthesis | G(MOE)G(MOE)G(MOE)AGCCACCAUGGACUAUAAAGACGACGACGAUAAAG GUGGCGACUAUAAGGACGACGACGACAAAC(F)AUC(F)AUC(F)AUC(F)AUC (F)AUC(F)AUT(MOE)G(MOE)A(MOE) | 442 |
| E157 | Solid Phase Synthesis | G(MOE)G(MOE)G(MOE)AGCCACCAUGGACUAUAAAGACGACGACGAUAAAG GUGGCG(F)ACUAUAAGG(F)ACG(F)ACG(F)ACG(F)ACAAACACCACCACCAC CACCACT(MOE)G(MOE)A(MOE) | 443 |
| E158 | Solid Phase Synthesis | G(MOE)G(MOE)G(MOE)AGCCACCAUGGACUAUAAAGACGACGACGAUAAAG GUGGCG(F)AC(F)UAUAAGG(F)AC(F)G(F)AC(F)G(F)AC(F)G(F)AC(F) AAACACCACCACCACCACCACT(MOE)G(MOE)A(MOE) | 444 |
| E159 | Solid Phase Synthesis | G(MOE)G(MOE)G(MOE)AGCCACCAUGGACUAUAAAGACGACGACGAUAAAG GUGGCG(F)A(F)CUAUAAGG(F)A(F)CG(F)A(F)CG(F)A(F)CG(F)A(F) CAAACACCACCACCACCACCACT(MOE)G(MOE)A(MOE) | 445 |
| E160 | Solid Phase Synthesis | G(MOE)G(MOE)G(MOE)AGCCACCAUGGACUAUAAAGACGACGACGAUAAAG GUGGCGAUUAUAAGGAUGAUGAUGAUAAACACCACCACCACCACCACT(MOE) G(MOE)A(MOE) | 446 |
| E161 | Solid Phase Synthesis | G(MOE)G(MOE)G(MOE)AGCCACCAUGGACUAUAAAGACGACGACGAUAAAG GUGGCGAUUAUAAGG(F)AUGAUGAUGAUAAACACCACCACCACCACCACT (MOE)G(MOE)A(MOE) | 447 |
| E162 | Solid Phase Synthesis | G(MOE)G(MOE)G(MOE)AGCCACCAUGGACUAUAAAGACGACGACGAUAAAG GUGGCGAUUAUAAGG(F)AU(M)GAUGAUGAUAAACACCACCACCACCACCA CT(MOE)G(MOE)A(MOE) | 448 |
| E163 | Solid Phase Synthesis | G(MOE)G(MOE)G(MOE)AGCCACCAUGGACUAUAAAGACGACGACGAUAAAG GUGGCGAUUAUAAGG(F)AT(MOE)GAUGAUGAUAAACACCACCACCACCAC CACT(MOE)G(MOE)A(MOE) | 449 |
| E164 | Solid Phase Synthesis | G(MOE)G(MOE)G(MOE)AGCCACCAUGGACUAUAAAGACGACGACGAUAAAG GUGGCGAUUAUAAGG(F)AT(L)GAUGAUGAUAAACACCACCACCACCACCA CT(MOE)G(MOE)A(MOE) | 450 |
| E165 | Solid Phase Synthesis | G(MOE)G(MOE)G(MOE)AGCCACCAUGGACUAUAAAGACGACGACGAUAAAG GUGGCGAUUAUAAGG(F)A(F)UGAUGAUGAUAAACACCACCACCACCACCA CT(MOE)G(MOE)A(MOE) | 451 |

TABLE 51

| | | | |
|---|---|---|---|
| E166 | Solid Phase Synthesis | G(MOE)G(MOE)G(MOE)AGCCACCAUGGACUAUAAAGACGACGACGAUAAAG GUGGCGAUUAUAAGG(F)A(F)U(M)GAUGAUGAUAAACACCACCACCACCAC CACT(MOE)G(MOE)A(MOE) | 452 |
| E167 | Solid Phase Synthesis | G(MOE)G(MOE)G(MOE)AGCCACCAUGGACUAUAAAGACGACGACGAUAAAG GUGGCGAUUAUAAGG(F)aUGAUGAUGAUAAACACCACCACCACCACCACT (MOE)G(MOE)A(MOE) | 453 |
| E168 | Solid Phase Synthesis | G(MOE)G(MOE)G(MOE)AGCCACCAUGGACUAUAAAGACGACGACGAUAAAG GUGGCGAUUAUAAGG(F)AUG(F)AUGAUGAUAAACACCACCACCACCACCA CT(MOE)G(MOE)A(MOE) | 454 |
| E169 | Solid Phase Synthesis | G(MOE)G(MOE)G(MOE)AGCCACCAUGGACUAUAAAGACGACGACGAUAAAG GUGGCGAUUAUAAGG(F)AU(M)G(F)AU(M)GAUGAUAAACACCACCACCACC ACCACT(MOE)G(MOE)A(MOE) | 455 |
| E170 | Solid Phase Synthesis | G(MOE)G(MOE)G(MOE)AGCCACCAUGGACUAUAAAGACGACGACGAUAAAG GUGGCGAUUAUAAGG(F)AT(L)G(F)AT(L)GAUGAUAAACACCACCACCACCA CCACT(MOE)G(MOE)A(MOE) | 456 |
| E171 | Solid Phase Synthesis | G(MOE)G(MOE)G(MOE)AGCCACCAUGGACUAUAAAGACGACGACGAUAAAG GUGGCGAUUAUAAGG(F)A(F)UG(F)A(F)UGAUGAUAAACACCACCACCACCA CCACT(MOE)G(MOE)A(MOE) | 457 |
| E172 | Solid Phase Synthesis | G(MOE)G(MOE)G(MOE)AGCCACCAUGGACUAUAAAGACGACGACGAUAAAG GUGGCGAUUAUAAGG(F)A(F)U(M)G(F)A(F)U(M)GAUGAUAAACACCACCAC CACCACCACT(MOE)G(MOE)A(MOE) | 458 |
| E173 | Solid Phase Synthesis | G(MOE)G(MOE)G(MOE)AGCCACCAUGGACUAUAAAGACGACGACGAUAAAG GUGGCGAUUAUAAGG(F)aUG(F)aUGAUGAUAAACACCACCACCACCACCAC T(MOE)G(MOE)A(MOE) | 459 |

TABLE 51-continued

| | | | |
|---|---|---|---|
| E174 | Solid Phase Synthesis | G(MOE)G(MOE)G(MOE)AGCCACCAUGGACUAUAAAGACGACGACGAUAAAG GUGGCG(F)AUUAUAAGG(F)AUG(F)AUG(F)AUG(F)AUAAACACCACCACCAC CACCACT(MOE)G(MOE)A(MOE) | 460 |
| E175 | Solid Phase Synthesis | G(MOE)G(MOE)G(MOE)AGCCACCAUGGACUAUAAAGACGACGACGAUAAAG GUGGCG(F)A(F)UUAUAAGG(F)A(F)UG(F)A(F)UG(F)A(F)UG(F)A(F) UAAACACCACCACCACCACCACT(MOE)G(MOE)A(MOE) | 461 |
| E176 | Solid Phase Synthesis | G(MOE)G(MOE)G(MOE)AGCCACCAUGGACUAUAAAGACGACGACGAUAAAG GUGGCGAUUAUAAGGAUG(F)A(F)U(M)GAUGAUAAACACCACCACCACCAC CACT(MOE)G(MOE)A(MOE) | 462 |
| E177 | Solid Phase Synthesis | G(MOE)G(MOE)G(MOE)AGCCACCAUGGACUAUAAAGACGACGACGAUAAAG GUGGCGAUUAUAAGGAUG(F)aUGAUGAUAAACACCACCACCACCACCACT (MOE)G(MOE)A(MOE) | 463 |
| E178 | Solid Phase Synthesis | G(MOE)G(MOE)G(MOE)AGCCACCAUGGACUAUAAAGACGACGACGAUAAAG GUGGCGACU(F)AUAAGGACGACGACGACAAACACCACCACCACCACCACT (MOE)G(MOE)A(MOE) | 464 |
| E179 | Solid Phase Synthesis | G(MOE)G(MOE)G(MOE)AGCCACCAUGGACUAUAAAGACGACGACGAUAAAG GUGGCGACU(F)AU(M)AAGGACGACGACGACAAACACCACCACCACCACCA CT(MOE)G(MOE)A(MOE) | 465 |
| E180 | Solid Phase Synthesis | G(MOE)G(MOE)G(MOE)AGCCACCAUGGACUAUAAAGACGACGACGAUAAAG GUGGCGACU(F)AT(L)AAGGACGACGACGACAAACACCACCACCACCACCA CT(MOE)G(MOE)A(MOE) | 466 |

TABLE 52

| | | | |
|---|---|---|---|
| E181 | Solid Phase Synthesis | G(MOE)G(MOE)G(MOE)AGCCACCAUGGACUAUAAAGACGACGACGAUAAAG GUGGCGACU(F)A(F)UAAGGACGACGACGACAAACACCACCACCACCACCA CT(MOE)G(MOE)A(MOE) | 467 |
| E182 | Solid Phase Synthesis | G(MOE)G(MOE)G(MOE)AGCCACCAUGGACUAUAAAGACGACGACGAUAAAG GUGGCGACUAUAAGGACGACGACGACAAGCACCACCACCACCACCACT(M OE)G(MOE)A(MOE) | 468 |
| E183 | Solid Phase Synthesis | G(MOE)G(MOE)G(MOE)AGCCACCAUGGACUAUAAAGACGACGACGAUAAAG GUGGCGACUAUA(F)AGGACGACGACGACA(F)AGCACCACCACCACCACCA CT(MOE)G(MOE)A(MOE) | 469 |
| E184 | Solid Phase Synthesis | G(MOE)G(MOE)G(MOE)AGCCACCAUGGACUAUAAAGACGACGACGAUAAAG GUGGCGACUAUA(F)AG(M)GACGACGACGACA(F)AG(M)CACCACCACCACC ACCACT(MOE)G(MOE)A(MOE) | 470 |
| E185 | Solid Phase Synthesis | G(MOE)G(MOE)G(MOE)AGCCACCAUGGACUAUAAAGACGACGACGAUAAAG GUGGCGACUAUA(F)AG(L)GACGACGACGACA(F)AG(L)CACCACCACCACC ACCACT(MOE)G(MOE)A(MOE) | 471 |
| E186 | Solid Phase Synthesis | G(MOE)G(MOE)G(MOE)AGCCACCAUGGACUAUAAAGACGACGACGAUAAAG GUGGCGACUAUA(F)A(F)GGACGACGACGACA(F)A(F)GCACCACCACCACC ACCACT(MOE)G(MOE)A(MOE) | 472 |
| E187 | Solid Phase Synthesis | G(MOE)G(MOE)G(MOE)AGCCACCAUGGACUAUAAGGACGACGACGACAAAG GUGGCA(F)GC(F)CACCACCACCACCACCACT(MOE)G(MOE)A(MOE) | 473 |
| E188 | Solid Phase Synthesis | G(MOE)G(MOE)G(MOE)AGCCACCAUGGACUAUAAGGACGACGACGACAAAG GUGGCA(F)GC(M)CACCACCACCACCACCACT(MOE)G(MOE)A(MOE) | 474 |
| E189 | Solid Phase Synthesis | G(MOE)G(MOE)G(MOE)AGCCACCAUGGACUAUAAGGACGACGACGACAAAG GUGGCA(F)GcCACCACCACCACCACCACT(MOE)G(MOE)A(MOE) | 475 |
| E190 | Solid Phase Synthesis | G(MOE)G(MOE)G(MOE)AGCCACCAUGGACUAUAAGGACGACGACGACAAAG GUGGCA(F)GCCACCACCACCACCACCACT(MOE)G(MOE)A(MOE) | 476 |
| E191 | Solid Phase Synthesis | G(MOE)G(MOE)G(MOE)AGCCACCAUGGACUAUAAGGACGACGACGACAAAG GUGGCA(F)G(F)C(F)CACCACCACCACCACCACT(MOE)G(MOE)A(MOE) | 477 |
| E192 | Solid Phase Synthesis | G(MOE)G(MOE)G(MOE)AGCCACCAUGGACUAUAAGGACGACGACGACAAAG GUGGCA(F)G(F)CCACCACCACCACCACCACT(MOE)G(MOE)A(MOE) | 478 |
| E193 | Solid Phase Synthesis | G(MOE)G(MOE)G(MOE)AGCCACCAUGGACUAUAAGGACGACGACGACAAAG GUGGCA(F)gCCACCACCACCACCACCACT(MOE)G(MOE)A(MOE) | 479 |

TABLE 52-continued

| | | | |
|---|---|---|---|
| E194 | Solid Phase Synthesis | G(MOE)G(MOE)G(MOE)AGCCACCAUGGACUAUAAGGACGACGACGACAAAG GUGGCAGUCACCACCACCACCACCACT(MOE)G(MOE)A(MOE) | 480 |
| E195 | Solid Phase Synthesis | G(MOE)G(MOE)G(MOE)AGCCACCAUGGACUAUAAGGACGACGACGACAAAG GUGGCA(F)GU(F)CACCACCACCACCACCACT(MOE)G(MOE)A(MOE) | 481 |
| E196 | Solid Phase Synthesis | G(MOE)G(MOE)G(MOE)AGCCACCAUGGACUAUAAGGACGACGACGACAAAG GUGGCA(F)GU(M)CACCACCACCACCACCACT(MOE)G(MOE)A(MOE) | 482 |
| E197 | Solid Phase Synthesis | G(MOE)G(MOE)G(MOE)AGCCACCAUGGACUAUAAGGACGACGACGACAAAG GUGGCA(F)GtCACCACCACCACCACCACT(MOE)G(MOE)A(MOE) | 483 |
| E198 | Solid Phase Synthesis | G(MOE)G(MOE)G(MOE)AGCCACCAUGGACUAUAAGGACGACGACGACAAAG GUGGCA(F)GUCACCACCACCACCACCACT(MOE)G(MOE)A(MOE) | 484 |

TABLE 53

| | | | |
|---|---|---|---|
| E199 | Solid Phase Synthesis | G(MOE)G(MOE)G(MOE)AGCCACCAUGGACUAUAAGGACGACGACGACAAAG GUGGCA(F)G(F)UCACCACCACCACCACCACT(MOE)G(MOE)A(MOE) | 485 |
| E200 | Solid Phase Synthesis | G(MOE)G(MOE)G(MOE)AGCCACCAUGGACUAUAAGGACGACGACGACAAAG GUGGCUGGCACCACCACCACCACCACT(MOE)G(MOE)A(MOE) | 486 |
| E201 | Solid Phase Synthesis | G(MOE)G(MOE)G(MOE)AGCCACCAUGGACUAUAAGGACGACGACGACAAAG GUGGCU(F)GG(F)CACCACCACCACCACCACT(MOE)G(MOE)A(MOE) | 487 |
| E202 | Solid Phase Synthesis | G(MOE)G(MOE)G(MOE)AGCCACCAUGGACUAUAAGGACGACGACGACAAAG GUGGCU(F)GG(M)CACCACCACCACCACCACT(MOE)G(MOE)A(MOE) | 488 |
| E203 | Solid Phase Synthesis | G(MOE)G(MOE)G(MOE)AGCCACCAUGGACUAUAAGGACGACGACGACAAAG GUGGCU(F)GGCACCACCACCACCACCACT(MOE)G(MOE)A(MOE) | 489 |
| E204 | Solid Phase Synthesis | G(MOE)G(MOE)G(MOE)AGCCACCAUGGACUAUAAGGACGACGACGACAAAG GUGGCU(F)G(F)GCACCACCACCACCACCACT(MOE)G(MOE)A(MOE) | 490 |
| E205 | Solid Phase Synthesis | G(MOE)G(MOE)G(MOE)AGCCACCAUGGACUAUAAGGACGACGACGACAAAG GUGGCUGUCACCACCACCACCACCACT(MOE)G(MOE)A(MOE) | 491 |
| E206 | Solid Phase Synthesis | G(MOE)G(MOE)G(MOE)AGCCACCAUGGACUAUAAGGACGACGACGACAAAG GUGGCU(F)GU(F)CACCACCACCACCACCACT(MOE)G(MOE)A(MOE) | 492 |
| E207 | Solid Phase Synthesis | G(MOE)G(MOE)G(MOE)AGCCACCAUGGACUAUAAGGACGACGACGACAAAG GUGGCU(F)GU(M)CACCACCACCACCACCACT(MOE)G(MOE)A(MOE) | 493 |
| E208 | Solid Phase Synthesis | G(MOE)G(MOE)G(MOE)AGCCACCAUGGACUAUAAGGACGACGACGACAAAG GUGGCU(F)GUCACCACCACCACCACCACT(MOE)G(MOE)A(MOE) | 494 |
| E209 | Solid Phase Synthesis | G(MOE)G(MOE)G(MOE)AGCCACCAUGGACUAUAAGGACGACGACGACAAAG GUGGCU(F)G(F)UCACCACCACCACCACCACT(MOE)G(MOE)A(MOE) | 495 |
| E210 | Solid Phase Synthesis | G(MOE)G(MOE)G(MOE)AGCCACCAUGGACUAUAAGGACGACGACGACAAAG GUGGCUGCCACCACCACCACCACCACT(MOE)G(MOE)A(MOE) | 496 |
| E211 | Solid Phase Synthesis | G(MOE)G(MOE)G(MOE)AGCCACCAUGGACUAUAAGGACGACGACGACAAAG GUGGCU(F)GC(F)CACCACCACCACCACCACT(MOE)G(MOE)A(MOE) | 497 |
| E212 | Solid Phase Synthesis | G(MOE)G(MOE)G(MOE)AGCCACCAUGGACUAUAAGGACGACGACGACAAAG GUGGCU(F)GC(M)CACCACCACCACCACCACT(MOE)G(MOE)A(MOE) | 498 |
| E213 | Solid Phase Synthesis | G(MOE)G(MOE)G(MOE)AGCCACCAUGGACUAUAAGGACGACGACGACAAAG GUGGCU(F)GcCACCACCACCACCACCACT(MOE)G(MOE)A(MOE) | 499 |
| E214 | Solid Phase Synthesis | G(MOE)G(MOE)G(MOE)AGCCACCAUGGACUAUAAGGACGACGACGACAAAG GUGGCU(F)GCCACCACCACCACCACCACT(MOE)G(MOE)A(MOE) | 500 |
| E215 | Solid Phase Synthesis | G(MOE)G(MOE)G(MOE)AGCCACCAUGGACUAUAAGGACGACGACGACAAAG GUGGCAUCCACCACCACCACCACCACT(MOE)G(MOE)A(MOE) | 501 |
| E216 | Solid Phase Synthesis | G(MOE)G(MOE)G(MOE)AGCCACCAUGGACUAUAAGGACGACGACGACAAAG GUGGCA(F)UC(F)CACCACCACCACCACCACT(MOE)G(MOE)A(MOE) | 502 |

TABLE 53-continued

| | | | |
|---|---|---|---|
| E217 | Solid Phase Synthesis | G(MOE)G(MOE)G(MOE)AGCCACCAUGGACUAUAAGGACGACGACGACAAAG GUGGCA(F)UC(M)CACCACCACCACCACCACT(MOE)G(MOE)A(MOE) | 503 |
| E218 | Solid Phase Synthesis | G(MOE)G(MOE)G(MOE)AGCCACCAUGGACUAUAAGGACGACGACGACAAAG GUGGCA(F)UcCACCACCACCACCACCACT(MOE)G(MOE)A(MOE) | 504 |

TABLE 54

| | | | |
|---|---|---|---|
| E219 | Solid Phase Synthesis | G(MOE)G(MOE)G(MOE)AGCCACCAUGGACUAUAAGGACGACGACGACAAAG GUGGCA(F)UCCACCACCACCACCACCACT(MOE)G(MOE)A(MOE) | 505 |
| E220 | Solid Phase Synthesis | G(MOE)G(MOE)G(MOE)AGCCACCAUGGACUAUAAGGACGACGACGACAAAG GUGGCA(F)U(F)CCACCACCACCACCACCACT(MOE)G(MOE)A(MOE) | 506 |
| E221 | Solid Phase Synthesis | G(MOE)G(MOE)G(MOE)AGCCACCAUGGACUAUAAGGACGACGACGACAAAG GUGGCA(F)UUCACCACCACCACCACCACT(MOE)G(MOE)A(MOE) | 507 |
| E222 | Solid Phase Synthesis | G(MOE)G(MOE)G(MOE)AGCCACCAUGGACUAUAAGGACGACGACGACAAAG GUGGCA(F)UU(F)CACCACCACCACCACCACT(MOE)G(MOE)A(MOE) | 508 |
| E223 | Solid Phase Synthesis | G(MOE)G(MOE)G(MOE)AGCCACCAUGGACUAUAAGGACGACGACGACAAAG GUGGCA(F)UU(M)CACCACCACCACCACCACT(MOE)G(MOE)A(MOE) | 509 |
| E224 | Solid Phase Synthesis | G(MOE)G(MOE)G(MOE)AGCCACCAUGGACUAUAAGGACGACGACGACAAAG GUGGCA(F)UtCACCACCACCACCACCACT(MOE)G(MOE)A(MOE) | 510 |
| E225 | Solid Phase Synthesis | G(MOE)G(MOE)G(MOE)AGCCACCAUGGACUAUAAGGACGACGACGACAAAG GUGGCA(F)UUCACCACCACCACCACCACT(MOE)G(MOE)A(MOE) | 511 |
| E226 | Solid Phase Synthesis | G(MOE)G(MOE)G(MOE)AGCCACCAUGGACUAUAAGGACGACGACGACAAAG GUGGCA(F)U(F)U(M)CACCACCACCACCACCACT(MOE)G(MOE)A(MOE) | 512 |
| E227 | Solid Phase Synthesis | G(MOE)G(MOE)G(MOE)AGCCACCAUGGACUAUAAGGACGACGACGACAAAG GUGGCA(F)U(F)UCACCACCACCACCACCACT(MOE)G(MOE)A(MOE) | 513 |
| E228 | Solid Phase Synthesis | G(MOE)G(MOE)G(MOE)AGCCACCAUGGACUAUAAGGACGACGACGACAAAG GUGGCA(F)tUCACCACCACCACCACCACT(MOE)G(MOE)A(MOE) | 514 |
| E229 | Solid Phase Synthesis | G(MOE)G(MOE)G(MOE)AGCCACCAUGG(F)A(F)CUAUAAAG(F)ACF)CG (F)AC(F)CG(F)A(F)CGAUAAAGGUGGCG(F)A(F)CUAUAAGG(F)A(F) CG(F)A(F)CG(F)A(F)CGACAAACACCACCACCACCACCACT(MOE)G(MOE) A(MOE) | 515 |
| E230 | Solid Phase Synthesis | G(MOE)G(MOE)G(MOE)AGCCACCAUGG(F)ACUAUAAAGACGACG(F)ACF)CG AUAAAGGUGGCG(F)A(F)CUAUAAGGACGACG(F)ACG(F)ACAAACACCACCA CCACCACCACT(MOE)G(MOE)A(MOE) | 516 |
| E231 | Solid Phase Synthesis | G(MOE)G(MOE)G(MOE)AGCCACCAUGGACUAUAAAG(F)A(F)CG(F)A(F)CGA CGAUAAAGGUGGCGACUAUAAGG(F)A(F)CG(F)A(F)CGACGACAAACACCAC CACCACCACCACT(MOE)G(MOE)A(MOE) | 517 |
| E232 | Solid Phase Synthesis | G(MOE)G(MOE)G(MOE)AGCCACCAUGGA(F)CUAUAAAGA(F)CGA(F)CGA(F) CGAUAAAGGUGGCGA(F)CUAUAAGGA(F)CGA(F)CGA(F)CGACAAACACCAC CACCACCACCACT(MOE)G(MOE)A(MOE) | 518 |
| E233 | Solid Phase Synthesis | G(MOE)G(MOE)G(MOE)AGCCACCAUGGA(F)CUAUAAAGACGACGA(F)CGAU AAAGGUGGCG(F)ACUAUAAGGACGACGA(F)CGACAAACACCACCACCACC ACCACT(MOE)G(MOE)A(MOE) | 519 |
| E234 | Solid Phase Synthesis | G(MOE)G(MOE)G(MOE)AGCCACCAUGGACUAUAAAGA(F)CGA(F)CGACGAU AAAGGUGGCGACUAUAAGGA(F)CGA(F)CGACGACAAACACCACCACCACC ACCACT(MOE)G(MOE)A(MOE) | 520 |
| E235 | Solid Phase Synthesis | G(MOE)G(MOE)G(MOE)AGCCACCAUGGACUAUAAAGACGACGACGAUAAAG GUGGCGACUAUAAGGA(F)CGA(F)CGACGACAAACACCACCACCACCACCA CT(MOE)G(MOE)A(MOE) | 521 |

TABLE 55

| | | | |
|---|---|---|---|
| E236 | Solid Phase Synthesis | G(MOE)G(MOE)G(MOE)AGCCACCAUGGACUAUAAAGACGACGACGAUAAAG<br>GUGGCGACUAUAAGGA(L)CGACGACGACAAACACCACCACCACCACCACT<br>(MOE)G(MOE)A(MOE) | 522 |
| E237 | Solid Phase Synthesis | G(MOE)G(MOE)G(MOE)AGCCACCAUGGACUAUAAAGACGACGACGAUAAAG<br>GUGGCGACUAUAAGGA(L)CGA(L)CGACGACAAACACCACCACCACCACCA<br>CT(MOE)G(MOE)A(MOE) | 523 |
| E238 | Solid Phase Synthesis | G(MOE)G(MOE)G(MOE)AGCCACCAUGGACUAUAAAGACGACGACGAUAAAG<br>GUGGCGACUAUAAGG(F)^ACGACGACGACAAACACCACCACCACCACCAC<br>T(MOE)G(MOE)A(MOE) | 524 |
| E239 | Solid Phase Synthesis | G(MOE)G(MOE)G(MOE)AGCCACCAUGGACUAUAAAGACGACGACGAUAAAG<br>GUGGCGACUAUAAGG(F)^ACG(F)^ACGACGACAAACACCACCACCACCACC<br>ACT(MOE)G(MOE)A(MOE) | 525 |
| E240 | Solid Phase Synthesis | G(MOE)G(MOE)G(MOE)AGCCACCAUGG(F)^ACUAUAAAG(F)^ACG(F)^ACG<br>(F) ACGAUAAAGGUGGCG(F)^ACUAUAAGG(F)^ACG(F)^ACG(F)^ACGACAAAC<br>ACCACCACCACCACCACT(MOE)G(MOE)A(MOE) | 526 |
| E241 | Solid Phase Synthesis | G(MOE)G(MOE)G(MOE)AGCCACCAUGG(F)^ACUAUAAAGACGACG(F)^ACGA<br>UAAAGGUGGCG(F)^ACUAUAAGGACGACG(F)^ACGACAAACACCACCACCA<br>CCACCACT(MOE)G(MOE)A(MOE) | 527 |
| E242 | Solid Phase Synthesis | G(MOE)G(MOE)G(MOE)AGCCACCAUGGACUAUAAAG(F)^ACG(F)^ACGACGA<br>UAAAGGUGGCGACUAUAAGG(F)^ACG(F)^ACGACGACAAACACCACCACCA<br>CCACCACT(MOE)G(MOE)A(MOE) | 528 |
| E243 | Solid Phase Synthesis | G(MOE)G(MOE)G(MOE)AGCCACCAUGGACUAUAAAGACGACGACGAUAAAG<br>GUGGCGACUAUAAGGACGACGACGACAAAC(F)^ACC(F)^ACC(F)^ACC(F)^A<br>CC(F)ACC(F)ACT(MOE)G(MOE)A(MOE) | 529 |
| E244 | Solid Phase Synthesis | G(M)G(M)G(M)AGCCACCA(F)^UGG(F)^ACU(F)^AUA(F)^AAG(F)^ACG(F)^AC<br>G(F)^ACG(F)^AUA(F)^AAG(F)^GUG(F)^GCG(F)^ACU(F)^AUA(F)^AGG(F)^AC<br>G(F)ACG(F)ACG(F)^ACA(F)AAC(F)ACC(F)ACC(F)^ACC(F)ACC(F)^AC<br>C(F)^ACU(M)G(M)A(M) | 530 |
| E245 | Solid Phase Synthesis | G(MOE)^G(MOE)^G(MOE)AGCCACCA(F)^UGG(F)^ACU(F)^AUA(F)^AAG(F)^A<br>CG(F)^ACG(F)^ACG(F)^AUA(F)^AAG(F)^GUG(F)^GCG(F)^ACU(F)^AUA(F)^A<br>GG(F)^ACG(F)^ACG(F)^ACG(F)^ACA(F)AAC(F)ACC(F)ACC(F)^ACC(F)^A<br>CC(F)^ACC(F)^ACT(MOE)^G(MOE)^A(MOE) | 531 |
| E246 | Solid Phase Synthesis | G(M)^G(M)^G(M)^A(M)^G(M)^C(M)^C(M)^A(M)^C(M)^C(M)^A(M)^U(M)^G(M)^G<br>(M)^A(M)^C(M)^U(M)^A(M)^U(M)^A(M)^A(M)^A(M)^G(M)^A(M)^C(M)^G(M)^A(M)^<br>C(M)^G(M)^A(M)^C(M)^G(M)^A(M)^U(M)^A(M)^A(M)^A(M)^G(M)^G(M)^U(M)^<br>G(M)^G(M)^C(M)^G(M)^A(M)^C(M)^U(M)^A(M)^U(M)^A(M)^A(M)^G(M)^G(M)^<br>A(M)^C(M)^G(M)^A(M)^C(M)^G(M)^A(M)^C(M)^G(M)^A(M)^C(M)^A(M)^A(M)^A<br>(M)^C(M)^A(M)^C(M)^C(M)^A(M)^C(M)^C(M)^A(M)^C(M)^C(M)^A(M)^C(M)^C(M)^<br>A(M)^C(M)^C(M)^A(M)^C(M)^U(M)^G(M)^A | 532 |

TABLE 56

| | | | |
|---|---|---|---|
| E247 | Enzyme | G(F)G(M)G(F)A(M)G(F)A(M)AUACAAGCUACUUGUUCUUUUUGCAGCCACCA<br>UGGACUACAAGGACGACGACGACAAGAUCAUCGACUAUAAAGACGACGAC<br>GAUAAAGGUGGCGACUAUAAGGACGACGACGACAAACACCACCACCACCA<br>CCACU(M)^G(F)^A(M) | 533 |
| E247-1 | Solid Phase Synthesis | G(F)G(M)G(F)A(M)G(F)A(M)AUACAAGCUACUUGUUCUUUUUGCAGCCACCA<br>UGGACUACAAGGACGACGACGACAAGAUCAUCGACUAUAAAG | 534 |
| E247-2 | Solid Phase Synthesis | pACGACGACGAUAAAGGUGGCGACUAUAAGGACGACGACGACAAACACCA<br>CCACCACCACCACU(M)^G(F)^A(M) | 535 |
| E248 | Enzyme | G(F)^G(M)^G(F)^A(M)^G(F)A(M)AUACAAGCUACUUGUUCUUUUUGCAGCCA<br>CCAUGGACUACAAGGACGACGACGACAAGAUCAUCGACUAUAAAGACGAC<br>GACGAUAAAGGUGGCGACUAUAAGGACGACGACGACAAACACCACCACCA<br>CCACCACU(M)G(F)A(M) | 536 |
| E248-1 | Solid Phase Synthesis | G(F)^G(M)^G(F)^A(M)^G(F)A(M)AUACAAGCUACUUGUUCUUUUUGCAGCCA<br>CCAUGGACUACAAGGACGACGACGACAAGAUCAUCGACUAUAAAG | 537 |
| E248-1 | Solid Phase Synthesis | pACGACGACGAUAAAGGUGGCGACUAUAAGGACGACGACGACAAACACCA<br>CCACCACCACCACU(M)G(F)A(M) | 538 |

TABLE 57

| Compound Name | SEQ ID NO: | Yield (%) | MEASURED MS | CALCULATED MS |
|---|---|---|---|---|
| E5 | 79 | 22 | | |
| E5-1 | 80 | | 30561 | 30556 |
| E5-2 | 81 | | 27305 | 27301 |
| E5-3 | 82 | | 27550 | 27546 |
| E6 | 83 | 50 | | |
| E6-1 | 84 | | 28682 | 28677 |
| E6-2 | 85 | | 25826 | 25822 |
| E7 | 86 | 44 | | |
| E7-1 | 87 | | | |
| E7-2 | 88 | | | |
| E8 | 89 | 31 | | |
| E8-1 | 90 | | 25851 | 25848 |
| E8-2 | 91 | | 21065 | 21063 |
| E9 | 92 | 39 | | |
| E9-1 | 93 | | 25826 | 25823 |
| E9-2 | 94 | | 21149 | 21147 |
| E10 | 95 | 36 | | |
| E10-1 | 96 | | 25840 | 25839 |
| E10-2 | 97 | | 21093 | 21091 |
| E11 | 98 | 36 | | |
| E11-1 | 99 | | | |
| E11-2 | 100 | | | |
| E12 | 101 | 40 | | |
| E12-1 | 102 | | | |
| E12-2 | 103 | | | |
| E13 | 104 | 40 | | |
| E13-1 | 105 | | | |
| E13-2 | 106 | | | |
| E14 | 107 | 40 | | |
| E14-1 | 108 | | | |
| E14-2 | 109 | | | |
| E15 | 110 | 34 | | |
| E15-1 | 111 | | | |
| E15-2 | 112 | | | |
| E16 | 113 | 33 | | |
| E16-1 | 114 | | | |
| E16-2 | 115 | | | |
| E17 | 116 | 34 | | |
| E17-1 | 117 | | | |
| E17-2 | 118 | | | |
| E18 | 119 | 33 | | |
| E18-1 | 120 | | | |
| E18-2 | 121 | | | |

TABLE 58

| | | | | |
|---|---|---|---|---|
| E19 | 122 | 31 | | |
| E19-1 | 123 | | | |
| E19-2 | 124 | | | |
| E20 | 125 | 27 | | |
| E20-1 | 126 | | | |
| E20-2 | 127 | | | |
| E21 | 128 | 23 | | |
| E21-1 | 129 | | | |
| E21-2 | 130 | | | |
| E22 | 131 | 7 | | |
| E22-1 | 132 | | | |
| E22-2 | 133 | | | |
| E23 | 134 | 7 | | |
| E23-1 | 135 | | | |
| E23-2 | 136 | | | |
| E24 | 137 | 38 | | |
| E24-1 | 138 | | | |
| E24-2 | 139 | | | |
| E25 | 140 | 31 | | |
| E25-1 | 141 | | 25826 | 25823 |
| E25-2 | 142 | | 21070 | 21067 |
| E26 | 143 | 36 | | |
| E26-1 | 144 | | | |
| E26-2 | 145 | | | |
| E27 | 146 | 44 | | |
| E27-1 | 147 | | 25826 | 25823 |
| E27-2 | 148 | | 21093 | 21091 |
| E28 | 149 | 37 | | |

TABLE 58-continued

| | | | | |
|---|---|---|---|---|
| E28-1 | 150 | | | |
| E28-2 | 151 | | | |
| E29 | 152 | 40 | | |
| E29-1 | 153 | | 25826 | 25823 |
| E29-2 | 154 | | 21094 | 21091 |
| E30 | 155 | 33 | | |
| E30-1 | 156 | | | |
| E30-2 | 157 | | | |
| E31 | 158 | 35 | | |
| E31-1 | 159 | | 25824 | 25823 |
| E31-2 | 160 | | 21032 | 21031 |
| E32 | 161 | 45 | | |
| E32-1 | 162 | | | |
| E32-2 | 163 | | | |
| E33 | 164 | 48 | | |
| E33-1 | 165 | | 25826 | 25823 |
| E33-2 | 166 | | 21089 | 21087 |

TABLE 59

| | | | | |
|---|---|---|---|---|
| E34 | 167 | 48 | | |
| E34-1 | 168 | | | |
| E34-2 | 169 | | | |
| E35 | 170 | 37 | | |
| E35-1 | 171 | | 25826 | 25823 |
| E35-2 | 172 | | 21118 | 21115 |
| E36 | 173 | 24 | | |
| E36-1 | 174 | | | |
| E36-2 | 175 | | | |
| E37 | 176 | 31 | | |
| E37-1 | 177 | | | |
| E37-2 | 178 | | | |
| E38 | 179 | 25 | | |
| E38-1 | 180 | | | |
| E38-2 | 181 | | | |
| E39 | 182 | 27 | | |
| E39-1 | 183 | | 25825 | 25822 |
| E39-2 | 184 | | 21069 | 21067 |
| E40 | 185 | 27 | | |
| E40-1 | 186 | | | |
| E40-2 | 187 | | | |
| E41 | 188 | 27 | | |
| E41-1 | 189 | | 25826 | 25822 |
| E41-2 | 190 | | 21070 | 21067 |
| E42 | 191 | 38 | | |
| E42-1 | 192 | | | |
| E42-2 | 193 | | | |
| E43 | 194 | 38 | | |
| E43-1 | 195 | | 25825 | 25822 |
| E43-2 | 196 | | 21094 | 21091 |
| E44 | 197 | 27 | | |
| E44-1 | 198 | | | |
| E44-2 | 199 | | | |
| E45 | 200 | 30 | | |
| E45-1 | 201 | | 25825 | 25822 |
| E45-2 | 202 | | 21094 | 21091 |
| E46 | 203 | 34 | | |
| E46-1 | 204 | | 25826 | 25823 |
| E46-2 | 205 | | 27651 | 27647 |
| E47 | 206 | 35 | | |
| E47-1 | 207 | | | |
| E47-2 | 208 | | | |
| E48 | 209 | 34 | | |
| E48-1 | 210 | | 26116 | 26113 |
| E48-2 | 211 | | 21249 | 21247 |

TABLE 60

| | | | | |
|---|---|---|---|---|
| E49 | 212 | 31 | | |
| E49-1 | 213 | | 26116 | 26113 |
| E49-2 | 214 | | 27835 | 27831 |
| E50 | 215 | 31 | | |
| E50-1 | 216 | | 26116 | 26113 |
| E50-2 | 217 | | 27834 | 27831 |
| E51 | 218 | 33 | | |

TABLE 60-continued

| | | | | |
|---|---|---|---|---|
| E51-1 | 219 | | 26116 | 26113 |
| E51-2 | 220 | | 28023 | 28017 |
| E52 | 221 | 30 | | |
| E52-1 | 222 | | 26149 | 26145 |
| E52-2 | 223 | | 27867 | 27863 |
| E53 | 224 | 31 | | |
| E53-1 | 225 | | 26148 | 26145 |
| E53-2 | 226 | | 28088 | 28082 |
| E54 | 227 | 34 | | |
| E54-1 | 228 | | 25852 | 25849 |
| E54-2 | 229 | | 27688 | 27685 |
| E55 | 230 | 25 | | |
| E55-1 | 231 | | 25995 | 25991 |
| E55-2 | 232 | | 21024 | 21021 |
| E56 | 233 | 36 | | |
| E56-1 | 234 | | 25887 | 25883 |
| E56-2 | 235 | | 21024 | 21021 |
| E57 | 236 | 28 | | |
| E57-1 | 237 | | 26121 | 26117 |
| E57-2 | 238 | | 21023 | 21021 |
| E58 | 239 | 30 | | |
| E58-1 | 240 | | 26013 | 26009 |
| E58-2 | 241 | | 21024 | 21021 |
| E59 | 242 | 33 | | |
| E59-1 | 243 | | 26077 | 26073 |
| E59-2 | 244 | | 21103 | 21101 |
| E60 | 245 | 40 | | |
| E60-1 | 246 | | 25968 | 25965 |
| E60-2 | 247 | | 21103 | 21101 |
| E61 | 248 | 49 | | |
| E61-1 | 249 | | 25852 | 25849 |
| E61-2 | 250 | | 22102 | 22099 |
| E62 | 251 | 52 | | |
| E62-1 | 252 | | | |
| E62-2 | 253 | | | |
| E63 | 254 | 30 | | |
| E63-1 | 255 | | 25852 | 25849 |
| E63-2 | 256 | | 22021 | 22018 |

TABLE 61

| | | | | |
|---|---|---|---|---|
| E64 | 257 | 42 | | |
| E64-1 | 258 | | | |
| E64-2 | 259 | | | |
| E65 | 260 | 20 | | |
| E65-1 | 261 | | 25852 | 25849 |
| E65-2 | 262 | | 22045 | 22042 |
| E66 | 263 | 26 | | |
| E66-1 | 264 | | | |
| E66-2 | 265 | | | |
| E67 | 266 | 42 | | |
| E67-1 | 267 | | 25850 | 25849 |
| E67-2 | 268 | | 22059 | 22058 |
| E68 | 269 | 44 | | |
| E68-1 | 270 | | | |
| E68-2 | 271 | | | |
| E69 | 272 | 42 | | |
| E69-1 | 273 | | 25850 | 25849 |
| E69-2 | 274 | | 22083 | 22082 |
| E70 | 275 | 41 | | |
| E70-1 | 276 | | | |
| E70-2 | 277 | | | |
| E71 | 278 | 46 | | |
| E71-1 | 279 | | 25851 | 25849 |
| E71-2 | 280 | | 22060 | 22059 |
| E72 | 281 | 42 | | |
| E72-1 | 282 | | | |
| E72-2 | 283 | | | |
| E73 | 284 | 34 | | |
| E73-1 | 285 | | 25850 | 25849 |
| E73-2 | 286 | | 22109 | 22106 |
| E74 | 287 | 38 | | |
| E74-1 | 288 | | | |
| E74-2 | 289 | | | |
| E75 | 290 | 40 | | |
| E75-1 | 291 | | 25850 | 25849 |
| E75-2 | 292 | | 22100 | 22099 |

TABLE 61-continued

| | | | | |
|---|---|---|---|---|
| E76 | 293 | 45 | | |
| E76-1 | 294 | | | |
| E76-2 | 295 | | | |
| E77 | 296 | 28 | | |
| E77-1 | 297 | | 25850 | 25849 |
| E77-2 | 298 | | 22099 | 22098 |
| E78 | 299 | 43 | | |
| E78-1 | 300 | | | |
| E78-2 | 301 | | | |
| E79 | 302 | | | |

TABLE 62

| | | | | |
|---|---|---|---|---|
| E80 | 303 | | | |
| E81 | 304 | | | |
| E82 | 305 | | | |
| E83 | 306 | | | |
| E84 | 307 | | | |
| E85 | 308 | | | |
| E86 | 309 | 37 | | |
| E86-1 | 310 | | 26091 | 26087 |
| E86-2 | 311 | | 21212 | 21209 |
| E87 | 312 | 39 | | |
| E87-1 | 313 | | | |
| E87-2 | 314 | | | |
| E88 | 315 | 37 | | |
| E88-1 | 316 | | 25878 | 25877 |
| E88-2 | 317 | | 21115 | 21115 |
| E89 | 318 | 44 | | |
| E89-1 | 319 | | 25856 | 25855 |
| E89-2 | 320 | | 21080 | 21079 |
| E90 | 321 | 39 | | |
| E90-1 | 322 | | | |
| E90-2 | 323 | | | |
| E91 | 324 | 44 | | |
| E91-1 | 325 | | 25872 | 25871 |
| E91-2 | 326 | | 21112 | 21111 |
| E92 | 327 | 41 | | |
| E92-1 | 328 | | 25840 | 25839 |
| E92-2 | 329 | | 21112 | 21111 |
| E93 | 330 | 42 | | |
| E93-1 | 331 | | 25840 | 25839 |
| E93-2 | 332 | | 21096 | 21095 |
| E94 | 333 | 37 | | |
| E94-1 | 334 | | | |
| E94-2 | 335 | | | |
| E95 | 336 | 44 | | |
| E95-1 | 337 | | | |
| E95-2 | 338 | | | |
| E96 | 339 | 35 | | |
| E96-1 | 340 | | 25860 | 25859 |
| E96-2 | 341 | | 21100 | 21099 |
| E97 | 342 | 46 | | |
| E97-1 | 343 | | 25788 | 25787 |
| E97-2 | 344 | | 21051 | 21051 |
| E98 | 345 | 41 | | |
| E98-1 | 346 | | 25852 | 25851 |
| E98-2 | 347 | | 21084 | 21083 |

TABLE 63

| | | | | |
|---|---|---|---|---|
| E99 | 348 | 33 | | |
| E99-1 | 349 | | | |
| E99-2 | 350 | | | |
| E100 | 351 | 31 | | |
| E100-1 | 352 | | 25926 | 25929 |
| E100-2 | 353 | | 21132 | 21133 |
| E101 | 354 | 6 | | |
| E101-1 | 355 | | 30697 | 30695 |
| E101-2 | 356 | | 27355 | 27353 |
| E101-3 | 357 | | 28012 | 28010 |
| E102 | 358 | 6 | | |
| E102-1 | 359 | | 31007 | 31005 |
| E102-2 | 360 | | 27356 | 27353 |
| E102-3 | 361 | | 28191 | 28188 |

TABLE 63-continued

| | | | | |
|---|---|---|---|---|
| E103 | 362 | 1 | | |
| E103-1 | 363 | | | |
| E103-2 | 364 | | | |
| E103-3 | 365 | | | |
| E104 | 366 | 2 | | |
| E104-1 | 367 | | 30975 | 30973 |
| E104-2 | 368 | | 27357 | 27353 |
| E104-3 | 369 | | 28160 | 28156 |
| E105 | 370 | 8 | | |
| E105-1 | 371 | | | |
| E105-2 | 372 | | | |
| E105-3 | 373 | | | |
| E106 | 374 | 38 | | |
| E106-1 | 375 | | 28796 | 28793 |
| E106-2 | 376 | | 25913 | 25912 |
| E107 | 377 | 36 | | |
| E107-1 | 378 | | 29091 | 29090 |
| E107-2 | 379 | | 26081 | 26090 |
| E108 | 380 | 37 | | |
| E108-1 | 381 | | | |
| E108-2 | 382 | | | |
| E109 | 383 | 47 | | |
| E109-1 | 384 | | | |
| E109-2 | 385 | | | |
| E110 | 386 | 34 | | |
| E110-1 | 387 | | 26193 | 26193 |
| E110-2 | 388 | | 21280 | 21279 |
| E111 | 389 | 30 | | |
| E111-1 | 390 | | | |
| E111-2 | 391 | | | |
| E112 | 392 | 38 | | |
| E112-1 | 393 | | | |
| 1 E112-2 | 394 | | | |

TABLE 64

| | | | | |
|---|---|---|---|---|
| E113 | 395 | 29 | | |
| E113-1 | 396 | | 26114 | 26113 |
| E113-2 | 397 | | 34417 | 34415 |
| E114 | 398 | 25 | | |
| E114-1 | 399 | | 26146 | 26145 |
| E114-2 | 400 | | 34446 | 34448 |
| E115 | 401 | | | |
| E116 | 402 | | 30183 | 30178 |
| E117 | 403 | | 21600 | 21599 |
| E118 | 404 | | 20983 | 20982 |
| E119 | 405 | | 30778 | 30773 |
| E120 | 406 | | 21964 | 21962 |
| E121 | 407 | | 29762 | 26769 |
| E122 | 408 | | 28852 | 28848 |
| E123 | 409 | | 21018 | 21016 |
| E124 | 410 | | 30814 | 30809 |
| E125 | 411 | | 21999 | 21998 |
| E126 | 412 | | 29773 | 29767 |
| E127 | 413 | | 28804 | 28800 |
| E128 | 414 | | 28804 | 28802 |
| E129 | 415 | | 28815 | 28814 |
| E130 | 416 | | 28785 | 28784 |
| E131 | 417 | | 28805 | 28802 |
| E132 | 418 | | 28806 | 28804 |
| E133 | 419 | | 28818 | 28816 |
| E134 | 420 | | 28791 | 28786 |
| E135 | 421 | | 28799 | 28798 |
| E136 | 422 | | 28801 | 28800 |
| E137 | 423 | | 28813 | 28812 |
| E138 | 424 | | 28783 | 28782 |
| E139 | 425 | | 28798 | 28797 |
| E140 | 426 | | 28803 | 28801 |
| E141 | 427 | | 28808 | 28805 |
| E142 | 428 | | 28831 | 28829 |
| E143 | 429 | | 28770 | 28769 |
| E144 | 430 | | 28806 | 28805 |
| E145 | 431 | | 28811 | 28809 |
| E146 | 432 | | 28770 | 28769 |
| E147 | 433 | | 28800 | 28799 |
| E148 | 434 | | 28804 | 28803 |
| E149 | 435 | | 28832 | 28831 |

TABLE 64-continued

| | | | | |
|---|---|---|---|---|
| E150 | 436 | | 28856 | 28855 |
| E151 | 437 | | 28808 | 28807 |
| E152 | 438 | | 28836 | 28835 |
| E153 | 439 | | 28772 | 28771 |
| E154 | 440 | | 28812 | 28810 |

TABLE 65

| | | | |
|---|---|---|---|
| E155 | 441 | 28807 | 28804 |
| E156 | 442 | 28818 | 28816 |
| E157 | 443 | 28810 | 28808 |
| E158 | 444 | 28820 | 28818 |
| E159 | 445 | 28820 | 28818 |
| E160 | 446 | 28805 | 28803 |
| E161 | 447 | 28807 | 28805 |
| E162 | 448 | 28821 | 28819 |
| E163 | 449 | 28882 | 28877 |
| E164 | 450 | 28834 | 28831 |
| E165 | 451 | 28809 | 28807 |
| E166 | 452 | 28823 | 28821 |
| E167 | 453 | 28791 | 28789 |
| E168 | 454 | 28808 | 28807 |
| E169 | 455 | 28837 | 28835 |
| E170 | 456 | 28861 | 28859 |
| E171 | 457 | 28811 | 28811 |
| E172 | 458 | 28842 | 28839 |
| E173 | 459 | 28777 | 28775 |
| E174 | 460 | 28815 | 28813 |
| E175 | 461 | 28826 | 28823 |
| E176 | 462 | 28822 | 28821 |
| E177 | 463 | 28791 | 28789 |
| E178 | 464 | 28801 | 28800 |
| E179 | 465 | 28816 | 28814 |
| E180 | 466 | 28829 | 28826 |
| E181 | 467 | 28804 | 28802 |
| E182 | 468 | 28816 | 28814 |
| E183 | 469 | 28820 | 28818 |
| E184 | 470 | 28847 | 28846 |
| E185 | 471 | 28844 | 28842 |
| E186 | 472 | 28824 | 28822 |
| E187 | 473 | 21966 | 21966 |
| E188 | 474 | 21979 | 21978 |
| E189 | 475 | 21949 | 21948 |
| E190 | 476 | 21965 | 21964 |
| E191 | 477 | 21969 | 21968 |
| E192 | 478 | 21966 | 21966 |
| E193 | 479 | 21948 | 21948 |
| E194 | 480 | 21964 | 21963 |
| E195 | 481 | 21967 | 21967 |
| E196 | 482 | 21980 | 21979 |
| E197 | 483 | 21964 | 21963 |
| E198 | 484 | 21965 | 21965 |
| E199 | 485 | 21967 | 21967 |
| E200 | 486 | 21979 | 21979 |

TABLE 66

| | | | |
|---|---|---|---|
| E201 | 487 | 21983 | 21983 |
| E202 | 488 | 21996 | 21995 |
| E203 | 489 | 21981 | 21981 |
| E204 | 490 | 21984 | 21983 |
| E205 | 491 | | |
| E206 | 492 | | |
| E207 | 493 | | |
| E208 | 494 | | |
| E209 | 495 | | |
| E210 | 496 | | |
| E211 | 497 | | |
| E212 | 498 | | |
| E213 | 499 | | |
| E214 | 500 | | |
| E215 | 501 | | |
| E216 | 502 | | |
| E217 | 503 | | |
| E218 | 504 | | |

TABLE 66-continued

| | |
|---|---|
| E219 | 505 |
| E220 | 506 |
| E221 | 507 |
| E222 | 508 |
| E223 | 509 |
| E224 | 510 |
| E225 | 511 |
| E226 | 512 |
| E227 | 513 |
| E228 | 514 |
| E229 | 515 |
| E230 | 516 |
| E231 | 517 |
| E232 | 518 |
| E233 | 519 |
| E234 | 520 |
| E235 | 521 |
| E236 | 522 |
| E237 | 523 |
| E238 | 524 |
| E239 | 525 |
| E240 | 526 |
| E241 | 527 |
| E242 | 528 |
| E243 | 529 |
| E244 | 530 |

TABLE 67

| | | | | |
|---|---|---|---|---|
| E245 | 531 | | | |
| E246 | 532 | | | |
| E247 | 533 | 23 | | |
| E247-1 | 534 | | 25788 | 25787 |
| E247-2 | 535 | | 21084 | 21083 |
| E248 | 536 | 30 | | |
| E248-1 | 537 | | 25852 | 25851 |
| E248-1 | 538 | | 21051 | 21051 |

Test Example 6

(Translation Reaction Test of mRNA Sample with Hela Cell Lysate)

The respective compounds shown in Tables 21 to 56 were used to evaluate translation activity in a human cell system with a 1-Step Human Coupled IVT Kit (Thermo Fisher Scientific K.K., Catalog No. 88882). The translation reaction was performed under the same conditions as those in Test Example 2 (Translation Reaction of mRNA Sample with Hela Cell Lysate).

A translation product in a reaction solution after the translation reaction was detected by the following sandwich ELISA: First, 6*His, His-Tag antibody (Proteintech Group, Inc., Catalog No. 66005-1-Ig) was diluted with 0.1 M carbonate buffer (pH 9.4) to 3 μg/mL, and the resultant was dispensed into a 96 well ELISA plate (manufactured by Nunc Inc.) by 50 μL per well, and allowed to stand still at 4° C. overnight, and thus, a plate in which the antibody was immobilized was produced. Subsequently, the plate was washed with Tris Buffered Saline with Tween 20 (Santa Cruz Biotechnology, Catalog No. sc-24953) diluted 1× concentration with purified water (hereinafter referred to as the washing solution), and then, a washing solution obtained by diluting bovine serum albumin (Wako Pure Chemical Industries Ltd., Catalog No. 017-22231) to a final concentration of 3% (hereinafter referred to as the blocking solution) was dispensed thereinto by 200 μL per well, and the resultant was allowed to stand still at room temperature for 1 hour. After washing the plate with the washing solution, the translation reaction solution diluted with the blocking solution was dispensed thereinto by 50 μL per well, and the resultant was allowed to stand still at room temperature for 1 hour. At this point, a translation product polypeptide preparation of SEQ ID NO: 539 (manufactured by Cosmo Bio Co., Ltd.) was similarly diluted to each concentration with the blocking solution to be dispensed into the plate. After washing the plate with the washing solution, Monoclonal ANTI-FLAG M2-Peroxidase (HRP) Ab produced in mouse (manufactured by SIGMA, Catalog Antibody A8592-1MG) diluted 10,000 fold with the blocking solution was dispensed thereinto by 50 μL per well, and the resultant was allowed to stand still at room temperature for 1 hour. After washing the plate with the washing solution, 1-Step Ultra TMB-ELISA (Thermo Fisher Scientific K.K., Catalog No. 34028) was dispensed thereinto by 50 μL per well, and the resultant was allowed to stand still at room temperature for several minutes. Thereafter, 0.5 M sulfuric acid (manufactured by Wako Pure Chemical Industries Ltd.) was dispensed thereinto by 50 μL per well to stop the reaction, and then, absorbances at a measurement wavelength of 450 nm and a reference wavelength of 570 nm were measured with an absorptiometer (manufactured by BIORAD). A translation product concentration (nM) in each translation reaction solution quantitatively determined with a calibration curve created based on the absorbances of the polypeptide preparation, and a relative amount of the translation product calculated assuming that the amount obtained from R18 having no sugar modification is 1 are shown in the following tables:

Translation product polypeptide preparation:

```
                                          (SEQ ID NO: 539)
NH2-MDYKDDDDKIIDYKDDDDKGGDYKDDDDKHHHHHH-COOH
```

TABLE 68

| Concentration of Translation Product obtained from Compound | | | |
|---|---|---|---|
| Compound Name | SEQ ID NO: | Translation Product Concentration (nM) | Relative Amount of Translation Product |
| E1 | 1 | 0.233 | 0.51 |
| R6 | 33 | 0.553 | 1.22 |
| E2 | 5 | 0.580 | 1.28 |
| E3 | 8 | 0.587 | 1.29 |
| R14 | 57 | 0.307 | 0.68 |
| R15 | 60 | 2.220 | 4.90 |
| R18 | 72 | 0.453 | 1.00 |

TABLE 69

| Compound Name | SEQ ID NO: | Translation Product Concentration (nM) | Relative Amount of Translation Product |
|---|---|---|---|
| E4 | 11 | 2.560 | 3.92 |
| E15 | 110 | 1.877 | 2.87 |
| E16 | 113 | 2.486 | 3.80 |
| E17 | 116 | 1.918 | 2.93 |
| E18 | 119 | 2.089 | 3.20 |
| E19 | 122 | 1.780 | 2.72 |
| R18 | 72 | 0.654 | 1.00 |

TABLE 70

| Compound Name | SEQ ID NO: | Translation Product Concentration (nM) | Relative Amount of Translation Product |
|---|---|---|---|
| E11 | 98 | 1.866 | 13.00 |
| E12 | 101 | 1.527 | 10.65 |
| E13 | 104 | 0.755 | 5.26 |
| R18 | 72 | 0.143 | 1.00 |

TABLE 71

| Compound Name | SEQ ID NO: | Translation Product Concentration (nM) | Relative Amount of Translation Product |
|---|---|---|---|
| E4 | 11 | 1.200 | 6.97 |
| E8 | 89 | 0.225 | 1.30 |
| E38 | 179 | 0.929 | 5.40 |
| E39 | 182 | 0.934 | 5.43 |
| R18 | 72 | 0.172 | 1.00 |

TABLE 72

| Compound Name | SEQ ID NO: | Translation Product Concentration (nM) | Relative Amount of Translation Product |
|---|---|---|---|
| E11 | 98 | 2.727 | 11.69 |
| E12 | 101 | 2.827 | 12.11 |
| E13 | 104 | 0.873 | 3.74 |
| E14 | 107 | 1.860 | 7.97 |
| R18 | 72 | 0.233 | 1.00 |

TABLE 73

| Compound Name | SEQ ID NO: | Translation Product Concentration (nM) | Relative Amount of Translation Product |
|---|---|---|---|
| E26 | 143 | 1.227 | 8.76 |
| E27 | 146 | 1.807 | 12.90 |
| E32 | 161 | 2.060 | 14.71 |
| E33 | 164 | 1.673 | 11.95 |
| E42 | 191 | 1.307 | 9.33 |
| E43 | 194 | 0.633 | 4.52 |
| R18 | 72 | 0.140 | 1.00 |

TABLE 74

| Compound Name | SEQ ID NO: | Translation Product Concentration (nM) | Relative Amount of Translation Product |
|---|---|---|---|
| E1 | 1 | 0.240 | 1.71 |
| E7 | 86 | 0.353 | 2.52 |
| R18 | 72 | 0.140 | 1.00 |

TABLE 75

| Compound Name | SEQ ID NO: | Translation Product Concentration (nM) | Relative Amount of Translation Product |
|---|---|---|---|
| E39 | 182 | 0.647 | 0.79 |
| E40 | 185 | 0.727 | 0.89 |
| E41 | 188 | 0.640 | 0.78 |
| E44 | 197 | 0.913 | 1.11 |
| E45 | 200 | 0.540 | 0.66 |
| R18 | 72 | 0.820 | 1.00 |

TABLE 76

| Compound Name | SEQ ID NO: | Translation Product Concentration (nM) | Relative Amount of Translation Product |
|---|---|---|---|
| R6 | 33 | 0.507 | 0.80 |
| E46 | 203 | 6.387 | 10.08 |
| R18 | 72 | 0.633 | 1.00 |

TABLE 77

| Compound Name | SEQ ID NO: | Translation Product Concentration (nM) | Relative Amount of Translation Product |
|---|---|---|---|
| E33 | 164 | 1.493 | 1.33 |
| E34 | 167 | 2.027 | 1.80 |
| E35 | 170 | 1.120 | 0.99 |
| E36 | 173 | 0.373 | 0.33 |
| E37 | 176 | 1.373 | 1.22 |
| R18 | 72 | 1.127 | 1.00 |

TABLE 78

| Compound Name | SEQ ID NO: | Translation Product Concentration (nM) | Relative Amount of Translation Product |
|---|---|---|---|
| E28 | 149 | 1.767 | 1.02 |
| E29 | 152 | 1.440 | 0.83 |
| E44 | 197 | 1.367 | 0.79 |
| E45 | 200 | 1.460 | 0.85 |
| R18 | 72 | 1.727 | 1.00 |

TABLE 79

| Compound Name | SEQ ID NO: | Translation Product Concentration (nM) | Relative Amount of Translation Product |
|---|---|---|---|
| R15 | | 2.267 | 1.73 |
| E48 | 209 | 2.327 | 1.77 |
| E86 | 309 | 2.200 | 1.68 |
| R18 | 72 | 1.313 | 1.00 |

TABLE 80

| Compound Name | SEQ ID NO: | Translation Product Concentration (nM) | Relative Amount of Translation Product |
|---|---|---|---|
| E24 | 137 | 3.613 | 2.40 |
| E25 | 140 | 3.247 | 2.15 |
| E40 | 185 | 1.360 | 0.90 |
| E41 | 188 | 1.720 | 1.14 |
| R18 | 72 | 1.507 | 1.00 |

TABLE 81

| Compound Name | SEQ ID NO: | Translation Product Concentration (nM) | Relative Amount of Translation Product |
|---|---|---|---|
| E48 | 209 | 2.507 | 2.54 |
| E49 | 212 | 5.540 | 5.61 |
| E50 | 215 | 3.067 | 3.11 |
| E51 | 218 | 7.687 | 7.79 |
| E52 | 221 | 3.653 | 3.70 |
| E53 | 224 | 9.520 | 9.65 |
| R18 | 72 | 0.987 | 1.00 |

TABLE 82

| Compound Name | SEQ ID NO: | Translation Product Concentration (nM) | Relative Amount of Translation Product |
|---|---|---|---|
| E4 | 11 | 2.047 | 1.84 |
| E54 | 227 | 7.100 | 6.38 |
| R18 | 72 | 1.113 | 1.00 |

TABLE 83

| Compound Name | SEQ ID NO: | Translation Product Concentration (nM) | Relative Amount of Translation Product |
|---|---|---|---|
| E4 | 11 | 2.420 | 2.16 |
| E59 | 242 | 2.820 | 2.52 |
| E60 | 245 | 2.627 | 2.35 |
| R18 | 72 | 1.120 | 1.00 |

TABLE 84

| Compound Name | SEQ ID NO: | Translation Product Concentration (nM) | Relative Amount of Translation Product |
|---|---|---|---|
| E22 | 131 | 0.173 | 1.30 |
| E23 | 134 | 0.073 | 0.55 |
| E55 | 230 | 0.260 | 1.95 |
| E56 | 233 | 0.073 | 0.55 |
| E57 | 236 | 0.367 | 2.75 |
| E58 | 239 | 0.147 | 1.10 |
| R18 | 72 | 0.133 | 1.00 |

TABLE 85

| Compound Name | SEQ ID NO: | Translation Product Concentration (nM) | Relative Amount of Translation Product |
|---|---|---|---|
| E4 | 11 | 1.353 | 10.68 |
| E61 | 248 | 3.067 | 24.21 |
| E62 | 251 | 3.080 | 24.32 |
| E63 | 254 | 1.340 | 10.58 |
| E64 | 257 | 0.847 | 6.68 |
| R18 | 72 | 0.127 | 1.00 |

TABLE 86

| Compound Name | SEQ ID NO: | Translation Product Concentration (nM) | Relative Amount of Translation Product |
|---|---|---|---|
| E4 | 11 | 3.807 | 2.86 |
| E65 | 260 | 4.607 | 3.46 |
| E66 | 263 | 7.433 | 5.58 |
| E67 | 266 | 3.727 | 2.80 |
| E68 | 269 | 7.140 | 5.36 |
| R18 | 72 | 1.333 | 1.00 |

TABLE 87

| Compound Name | SEQ ID NO: | Translation Product Concentration (nM) | Relative Amount of Translation Product |
|---|---|---|---|
| E4 | 11 | 3.153 | 3.09 |
| E69 | 272 | 3.987 | 3.91 |
| E70 | 275 | 4.240 | 4.16 |
| E71 | 278 | 0.847 | 0.83 |
| E72 | 281 | 2.013 | 1.97 |
| R18 | 72 | 1.020 | 1.00 |

TABLE 88

| Compound Name | SEQ ID NO: | Translation Product Concentration (nM) | Relative Amount of Translation Product |
|---|---|---|---|
| E4 | 11 | 3.547 | 3.97 |
| E30 | 155 | 3.127 | 3.50 |
| E31 | 158 | 3.527 | 3.75 |
| E73 | 284 | 4.527 | 3.95 |
| E74 | 287 | 3.527 | 5.07 |
| R18 | 72 | 0.893 | 1.00 |

TABLE 89

| Compound Name | SEQ ID NO: | Translation Product Concentration (nM) | Relative Amount of Translation Product |
|---|---|---|---|
| E4 | 11 | 3.313 | 5.85 |
| E75 | 290 | 2.073 | 3.66 |
| E76 | 293 | 3.487 | 6.15 |
| E77 | 296 | 2.540 | 4.48 |
| E78 | 299 | 3.900 | 6.88 |
| R18 | 72 | 0.567 | 1.00 |

TABLE 90

| Compound Name | SEQ ID NO: | Translation Product Concentration (nM) | Relative Amount of Translation Product |
|---|---|---|---|
| E4 | 11 | 1.947 | 4.00 |
| E11 | 98 | 2.487 | 5.11 |
| E88 | 315 | 1.900 | 3.90 |
| E89 | 318 | 2.580 | 5.30 |
| E90 | 321 | 2.640 | 5.42 |
| R18 | 72 | 0.487 | 1.00 |

TABLE 91

| Compound Name | SEQ ID NO: | Translation Product Concentration (nM) | Relative Amount of Translation Product |
|---|---|---|---|
| E13 | 104 | 1.733 | 4.19 |
| E28 | 149 | 2.293 | 5.55 |
| E29 | 152 | 2.640 | 6.39 |
| E91 | 324 | 1.233 | 2.98 |
| R18 | 72 | 0.413 | 1.00 |

TABLE 92

| Compound Name | SEQ ID NO: | Translation Product Concentration (nM) | Relative Amount of Translation Product |
|---|---|---|---|
| E12 | 101 | 3.340 | 7.83 |
| E92 | 327 | 2.173 | 5.09 |
| E93 | 330 | 2.453 | 5.75 |
| R18 | 72 | 0.427 | 1.00 |

TABLE 93

| Compound Name | SEQ ID NO: | Translation Product Concentration (nM) | Relative Amount of Translation Product |
|---|---|---|---|
| E27 | 146 | 1.793 | 1.58 |
| E94 | 333 | 2.453 | 2.16 |
| E95 | 336 | 1.100 | 0.97 |
| E96 | 339 | 5.633 | 4.97 |
| E115 | 401 | 0.787 | 0.69 |
| R18 | 72 | 1.133 | 1.00 |

TABLE 94

| Compound Name | SEQ ID NO: | Translation Product Concentration (nM) | Relative Amount of Translation Product |
|---|---|---|---|
| E4 | 11 | 2.860 | 2.86 |
| E48 | 209 | 3.153 | 3.15 |
| E100 | 351 | 3.853 | 3.85 |
| E110 | 386 | 4.393 | 4.39 |
| R18 | 72 | 1.000 | 1.00 |

TABLE 95

| Compound Name | SEQ ID NO: | Translation Product Concentration (nM) | Relative Amount of Translation Product |
|---|---|---|---|
| E4 | 11 | 2.560 | 3.92 |
| E47 | 206 | 0.313 | 0.48 |
| E48 | 209 | 2.180 | 3.34 |
| E87 | 312 | 1.207 | 1.85 |
| E99 | 348 | 0.100 | 0.15 |
| E110 | 386 | 3.240 | 4.96 |
| R18 | 72 | 0.653 | 1.00 |

TABLE 96

| Compound Name | SEQ ID NO: | Translation Product Concentration (nM) | Relative Amount of Translation Product |
|---|---|---|---|
| E4 | 11 | 2.187 | 2.54 |
| E48 | 209 | 2.460 | 2.86 |
| E86 | 309 | 3.240 | 3.77 |
| E97 | 342 | 1.813 | 2.11 |
| E112 | 392 | 3.720 | 4.33 |
| R18 | 72 | 0.853 | 1.00 |

TABLE 97

| Compound Name | SEQ ID NO: | Translation Product Concentration (nM) | Relative Amount of Translation Product |
|---|---|---|---|
| E86 | 309 | 2.487 | 2.86 |
| E97 | 342 | 1.487 | 1.71 |
| E98 | 345 | 4.647 | 5.34 |
| E247 | 533 | 1.580 | 1.82 |
| E248 | 536 | 4.620 | 5.31 |
| R18 | 72 | 0.887 | 1.00 |

TABLE 98

| Compound Name | SEQ ID NO: | Translation Product Concentration (nM) | Relative Amount of Translation Product |
|---|---|---|---|
| R6 | 33 | 3.133 | 15.67 |
| E54 | 227 | 37.333 | 186.67 |
| E111 | 389 | 57.400 | 287.00 |
| R18 | 72 | 0.200 | 1.00 |

TABLE 99

| Compound Name | SEQ ID NO: | Translation Product Concentration (nM) | Relative Amount of Translation Product |
|---|---|---|---|
| E48 | 209 | 2.867 | 14.33 |
| E49 | 212 | 40.667 | 203.33 |
| E113 | 395 | 41.933 | 209.67 |
| E114 | 398 | 101.667 | 508.33 |
| R18 | 72 | 0.200 | 1.00 |

TABLE 100

| Compound Name | SEQ ID NO: | Translation Product Concentration (nM) | Relative Amount of Translation Product |
|---|---|---|---|
| E11 | 98 | 2.800 | 4.77 |
| E12 | 101 | 2.873 | 4.90 |
| E92 | 327 | 3.340 | 5.69 |
| E112 | 392 | 3.013 | 5.14 |
| R18 | 72 | 0.587 | 1.00 |

TABLE 101

| Compound Name | SEQ ID NO: | Translation Product Concentration (nM) | Relative Amount of Translation Product |
|---|---|---|---|
| E11 | 98 | 2.547 | 2.63 |
| E4 | 11 | 2.613 | 2.70 |
| E20 | 125 | 0.453 | 0.47 |
| E21 | 128 | 0.047 | 0.05 |
| E88 | 315 | 2.367 | 2.45 |
| E112 | 392 | 2.980 | 3.08 |
| R18 | 72 | 0.967 | 1.00 |

TABLE 102

| Compound Name | SEQ ID NO: | Translation Product Concentration (nM) | Relative Amount of Translation Product |
|---|---|---|---|
| E9 | 92 | 1.187 | 3.12 |
| E10 | 95 | 0.940 | 2.47 |
| R18 | 72 | 0.380 | 1.00 |

As is obvious from the test results described above, each compound having sugar modification produced, after being added to the Hela cell lysate, a polypeptide encoded by a gene sequence in the eukaryotic cell translation system.

Test Example 7

(In Vitro Translation Reaction Test of mRNA Sample with Hela Cell Line)

The respective compounds shown in Tables 21 to 56 were evaluated for translation activity in vitro with Hela cell line. First, a Hela cell suspended in RPMI medium (manufactured by Nacalai Tesque, Inc.) containing 10% fetal bovine serum was seeded in a 96 well adherent cell culture plate at 10,000 cells/100 μL per well, and the resultant was cultured at 37° C. under 5% CO2 condition overnight. A culture supernatant was removed from the cell cultured overnight, RPMI medium containing 40 μL of 10% fetal bovine serum per well was added thereto, and each compound and Lipofectamin Messenger MAX Transfection Reagent (manufactured by Thermo Fisher Scientific K.K., Catalog No: LMRNA008) at a final concentration of 0.3% were diluted and mixed with Opti-MEM (manufactured by Thermo Fisher Scientific K.K., Catalog No: 31985-070) to a final concentration of 0.1 μM of each compound, the resultant mixture was added to each culture plate in an amount of 10 μL per well, and the resultant was cultured at 37° C. under 5% CO2 condition for 5 hours. A culture supernatant was removed from the cell cultured for 5 hours, the resultant was washed once with ice cooled D-PBS(−) (manufactured by Nacalai Tesque, Inc.), and in each of the compounds shown in Table 103, NP-40 (Invitrogen Corp., FNN0021) containing 2% protease inhibitor cocktail (for an animal cell extract) was added in an amount of 20 μL per well, and the resultant was vigorously shaken for 30 seconds for cell lysis. In each of the compounds shown in Tables 104 and 105, iScript RT-qPCR Sample Preparation Reagent (BIORAD, 1708898) containing 2% protease inhibitor cocktail (for an animal cell extract) was added in an amount of 20 μL per well, and the resultant was vigorously shaken for 30 seconds for cell lysis.

A translation product in a cell lysate thus obtained was detected by the sandwich ELISA method described in Test Example 6 (Translation Reaction Test of mRNA Sample with Hela Cell Lysate). As results of the measurement, a translation product concentration (nM) in each translation reaction solution quantitatively determined with a calibration curve created based on the absorbances of the polypeptide preparation is shown in the following tables:

TABLE 103

| Compound Name | SEQ ID NO: | Translation Product Concentration (nM) |
|---|---|---|
| E2 | 5 | 0.030 |
| E51 | 218 | 1.970 |
| E53 | 224 | 2.387 |
| R18 | 72 | 0.010 |

TABLE 104

| Compound Name | SEQ ID NO: | Translation Product Concentration (nM) |
|---|---|---|
| E4 | 11 | 0.003 |
| E48 | 209 | 0.010 |
| E100 | 351 | 0.100 |
| E110 | 386 | 0.060 |
| R18 | 72 | 0.000 |

TABLE 105

| Compound Name | SEQ ID NO: | Translation Product Concentration (nM) |
|---|---|---|
| R6 | 33 | 0.020 |
| E54 | 227 | 0.373 |

TABLE 106

| Compound Name | SEQ ID NO: | Translation Product Concentration (nM) |
|---|---|---|
| E97 | 342 | 0.010 |
| E98 | 345 | 0.563 |
| E247 | 533 | 0.020 |
| E248 | 536 | 0.440 |

As is obvious from the test results described above, each mRNA having sugar modification produced, after being added to the Hela cell, a polypeptide encoded by a gene sequence, and the activity was equivalent to or higher than that of an mRNA having no sugar modification.

Test Example 8

(In Vitro Translation Reaction Test of mRNA Sample with Mouse Primary Hepatocyte)

The respective compounds shown in Tables 21 to 56 were evaluated for translation activity in vitro with a mouse primary hepatocyte (manufactured by Thermo Fisher Scientific K.K., Catalog No. MSCP10). First, a mouse primary hepatocyte suspended in William's E Medium, no phenol red (manufactured by Thermo Fisher Scientific K.K., catalog No. A1217601) containing Primary Hepatocyte Thawing and Plating Supplements (manufactured by Thermo Fisher Scientific K.K., Catalog No. CM3000) was seeded in a 96 well collagen I coated culture plate (manufactured by Corning Incorporated, Catalog No. 356407) at 10,000 cells/100 μL per well, and the resultant was cultured at 37° C. under 5% CO2 condition for 5 hours. A culture supernatant was removed from the cultured cell, William's E Medium, no phenol red containing Primary Hepatocyte Maintenance Supplements (manufactured by Thermo Fisher Scientific K.K., Catalog No. CM4000) was added thereto in an amount of 100 μL per well, and the resultant was further cultured at 37° C. under 5% CO2 condition for 5 hours. A culture supernatant was removed from the cell cultured overnight, William's E Medium, no phenol red containing Primary Hepatocyte Maintenance Supplements was added thereto in an amount of 40 μL per well, and thereafter, each compound and Lipofectamine Messenger MAX transfection Reagent in a final concentration of 0.3% were mixed and diluted with Opti-MEM to a final concentration of 0.1 μM of each compound, and the resultant mixture was added to each culture plate in an amount of 10 μL per well, followed by culturing at 37° C. under 5% CO2 condition for 5 hours. A culture supernatant was removed from the cell cultured for 5 hours, William's E Medium, no phenol red containing Primary Hepatocyte Maintenance Supplements was added thereto in an amount of 100 μL per well, and the resultant was further cultured at 37° C. under 5% CO2 condition for 1 hour. A culture supernatant was removed from the cell cultured for 1 hour, the resultant was washed with ice cooled D-PBS(−) (manufactured by Nacalai Tesque, Inc.) once, and NP-40 (Invitrogen Corp., FNN0021) containing 2% protease inhibitor cocktail (for an animal cell extract) was added thereto in an amount of 20 μL per well, and the resultant was vigorously shaken for 30 seconds for cell lysis.

A translation product in the thus obtained cell lysate was detected in the same manner as in the sandwich ELISA method described in Test Example 6 (Translation Reaction Test of mRNA Sample with Hela Cell Lysate). As results of the measurement, a translation product concentration (nM) in each translation reaction solution quantitatively determined with a calibration curve created based on the absorbances of the polypeptide preparation is shown in the following tables:

TABLE 107

| Compound Name | SEQ ID NO: | Translation Product Concentration (nM) |
|---|---|---|
| R18 | 72 | 0.000 |
| R6 | 33 | 0.010 |
| E2 | 5 | 0.030 |
| E46 | 203 | 0.170 |

TABLE 108

| Compound Name | SEQ ID NO: | Translation Product Concentration (nM) |
|---|---|---|
| R18 | 72 | 0.000 |
| E48 | 209 | 0.013 |
| E49 | 212 | 0.570 |
| E50 | 215 | 0.080 |
| E51 | 218 | 0.977 |
| E52 | 221 | 0.140 |
| E53 | 224 | 1.143 |

TABLE 108-continued

| Compound Name | SEQ ID NO: | Translation Product Concentration (nM) |
|---|---|---|
| E54 | 227 | 0.033 |
| E86 | 309 | 0.043 |

TABLE 109

| Compound Name | SEQ ID NO: | Translation Product Concentration (nM) |
|---|---|---|
| R18 | 72 | 0.000 |
| R6 | 33 | 0.001 |
| E4 | 11 | 0.001 |
| E48 | 209 | 0.008 |
| E53 | 224 | 0.181 |
| E100 | 351 | 0.018 |
| E110 | 386 | 0.012 |

As is obvious from the test results described above, each mRNA having sugar modification produced, after being added to the mouse hepatocyte, a polypeptide encoded by a gene sequence, and the activity was equivalent to or higher than that of an mRNA having no sugar modification.

Test Example 9

(In Vitro Translation Reaction Test of mRNA Sample with Hela Cell Line)

The respective compounds shown in Tables 21 to 56 were evaluated for translation activity in vitro with Hela cell line.

First, each compound was diluted with THE RNA Storage Solution (manufactured by Thermo Fisher Scientific K.K., Catalog No. AM7000) to a concentration of 20 μM. Hela cell line was suspended in a mixture of SE Cell Line Nucleofector Solution attached to SE Cell Line 96-well Nucleofector Kit (manufactured by Lonza, Catalog No. V4SC-1096) and Supplement 1 in a concentration of 200,000 cells/19 μL. The nucleic acid solution and the Hela cell suspension thus prepared were mixed in a volume ratio of 1:19, and the resultant was subjected to electroporation with Nucleofector™ 96-well Shuttle system (Lonza) under pulse condition FF-137. The resultant cell obtained 10 minutes after the electroporation was suspended in RPMI medium (manufactured by Nacalai Tesque, Inc.) containing 10% fetal bovine serum, and the resultant was seeded in a 96 well adherent cell culture plate at 50,000 cells/145 μL per well, followed by culturing at 37° C. under 5% CO2 condition for 3 hours. A culture supernatant was removed from the cell cultured for 3 hours, the resultant was washed once with ice cooled D-PBS(−) (manufactured by Nacalai Tesque, Inc.), iScript RT-qPCR Sample Preparation Reagent (BIORAD, 1708898) containing 2% protease inhibitor cocktail (for an animal cell extract) was added thereto in an amount of 20 μL per well, and the resultant was vigorously shaken for 30 seconds for cell lysis.

A translation product in a cell lysate thus obtained was detected in the same manner as in the sandwich ELISA method described in Test Example 6 (Translation Reaction Test of mRNA Sample with Hela Cell Lysate). As results of the measurement, a translation product concentration (nM) in each translation reaction solution quantitatively determined with a calibration curve created based on the absorbances of the polypeptide preparation is shown in the following table:

TABLE 110

| Concentration of Translation Product obtained from Compound | | |
|---|---|---|
| Compound Name | SEQ ID NO: | Translation Product Concentration (nM) |
| R6 | 33 | 0.000 |
| E53 | 224 | 0.133 |

As is obvious from the test results described above, each mRNA having sugar modification produced, after being electroporated into the Hela cell, a polypeptide encoded by a gene sequence, and the activity was more excellent than that of an mRNA having no sugar modification in the translated region.

Test Example 10

(Translation Reaction Test of mRNA Sample with Hela Cell Lysate)

The respective compounds shown in Tables 21 to 56 were used to evaluate translation activity in a human cell system with a 1-Step Human Coupled IVT Kit (Thermo Fisher Scientific K.K., Catalog No. 88882). The translation reaction was performed in the same manner as in Test Example 2 (Translation Reaction Test of mRNA Sample with Hela Cell Lysate) under condition of a nucleic acid final concentration of 1 μM.

A translation product in a reaction solution after the translation reaction was detected in accordance with the sandwich ELISA method described in Test Example 6 (Translation Reaction Test of mRNA Sample with Hela Cell Lysate) in the same manner except that a peptide of SEQ ID NO. 540 (manufactured by Cosmo Bio Co., Ltd.) was used as a translation product polypeptide preparation. A translation product concentration (nM) in each translation reaction solution quantitatively determined with a calibration curve created based on the absorbances of the polypeptide preparation, and a relative amount of the translation product calculated assuming that the amount obtained from each compound shown in the table having no sugar modification in the translated region is 1 are shown in the following tables:

Translation Product Polypeptide Preparation:

```
                                    (SEQ ID NO: 540)
NH2-MDYKDDDDKGGHHHHHH-COOH
```

TABLE 111

| Compound Name | SEQ ID NO: | Translation Product Concentration (nM) | Relative Amount of Translation Product |
|---|---|---|---|
| E79 | 302 | 0.779 | 1.00 |
| E80 | 303 | 5.567 | 7.14 |
| E121 | 407 | 3.633 | 4.66 |
| E126 | 412 | 3.938 | 5.05 |

TABLE 112

| Compound Name | SEQ ID NO: | Translation Product Concentration (nM) | Relative Amount of Translation Product |
|---|---|---|---|
| E83 | 306 | 0.782 | 1.00 |
| E118 | 404 | 5.055 | 6.46 |
| E123 | 409 | 3.884 | 4.96 |

TABLE 113

| Compound Name | SEQ ID NO: | Translation Product Concentration (nM) | Relative Amount of Translation Product |
|---|---|---|---|
| E116 | 402 | 0.577 | 1.00 |
| E119 | 405 | 4.672 | 8.10 |
| E124 | 410 | 2.909 | 5.04 |

TABLE 114

| Compound Name | SEQ ID NO: | Translation Product Concentration (nM) | Relative Amount of Translation Product |
|---|---|---|---|
| E117 | 403 | 0.836 | 1.00 |
| E120 | 406 | 4.820 | 5.76 |
| E125 | 411 | 4.541 | 5.43 |

TABLE 115

| Compound Name | SEQ ID NO: | Translation Product Concentration (nM) | Relative Amount of Translation Product |
|---|---|---|---|
| E79 | 302 | 5.033 | 1.00 |
| E80 | 303 | 96.233 | 19.12 |
| E81 | 304 | 71.667 | 14.24 |

TABLE 116

| Compound Name | SEQ ID NO: | Translation Product Concentration (nM) | Relative Amount of Translation Product |
|---|---|---|---|
| E187 | 473 | 20.901 | 5.35 |
| E188 | 474 | 12.683 | 3.24 |
| E189 | 475 | 14.535 | 3.72 |
| E190 | 476 | 13.642 | 3.49 |
| E191 | 477 | 5.424 | 1.39 |
| E192 | 478 | 12.415 | 3.18 |
| E193 | 479 | 9.485 | 2.43 |
| E194 | 480 | 13.019 | 3.33 |
| E195 | 481 | 13.292 | 3.40 |
| E196 | 482 | 15.400 | 3.94 |
| E197 | 483 | 6.598 | 1.69 |
| E117 | 403 | 3.909 | 1.00 |
| E120 | 406 | 17.240 | 4.41 |

TABLE 117

| Compound Name | SEQ ID NO: | Translation Product Concentration (nM) | Relative Amount of Translation Product |
|---|---|---|---|
| E198 | 484 | 14.951 | 2.92 |
| E199 | 485 | 22.911 | 4.47 |
| E200 | 486 | 36.407 | 7.11 |
| E201 | 487 | 10.375 | 2.03 |
| E202 | 488 | 9.028 | 1.76 |
| E203 | 489 | 32.056 | 6.26 |
| E117 | 403 | 5.123 | 1.00 |
| E120 | 406 | 27.522 | 5.37 |

TABLE 118

| Compound Name | SEQ ID NO: | Translation Product Concentration (nM) | Relative Amount of Translation Product |
|---|---|---|---|
| E204 | 490 | 20.103 | 4.23 |
| E117 | 403 | 4.752 | 1.00 |
| E120 | 406 | 21.482 | 4.52 |

TABLE 119

| Compound Name | SEQ ID NO: | Translation Product Concentration (nM) | Relative Amount of Translation Product |
|---|---|---|---|
| E205 | 491 | 26.627 | 3.17 |
| E206 | 492 | 11.000 | 1.31 |
| E207 | 493 | 22.453 | 2.68 |
| E208 | 494 | 18.787 | 2.24 |
| E209 | 495 | 31.427 | 3.75 |
| E117 | 403 | 8.387 | 1.00 |
| E120 | 406 | 35.800 | 4.27 |

TABLE 120

| Compound Name | SEQ ID NO: | Translation Product Concentration (nM) | Relative Amount of Translation Product |
|---|---|---|---|
| E210 | 496 | 6.653 | 1.28 |
| E211 | 497 | 7.267 | 1.39 |
| E212 | 498 | 5.707 | 1.09 |
| E213 | 499 | 7.453 | 1.43 |
| E214 | 500 | 7.773 | 1.49 |
| E117 | 403 | 5.213 | 1.00 |

TABLE 121

| Compound Name | SEQ ID NO: | Translation Product Concentration (nM) | Relative Amount of Translation Product |
|---|---|---|---|
| E120 | 406 | 28.507 | 5.47 |
| E215 | 501 | 17.773 | 2.44 |
| E216 | 502 | 9.933 | 1.36 |
| E217 | 503 | 10.547 | 1.45 |
| E218 | 504 | 22.253 | 3.05 |
| E219 | 505 | 14.867 | 2.04 |
| E220 | 506 | 11.147 | 1.53 |
| E117 | 403 | 7.293 | 1.00 |
| E120 | 406 | 29.160 | 4.00 |

TABLE 122

| Compound Name | SEQ ID NO: | Translation Product Concentration (nM) | Relative Amount of Translation Product |
|---|---|---|---|
| E221 | 507 | 30.333 | 4.06 |
| E222 | 508 | 31.573 | 4.23 |
| E223 | 509 | 28.000 | 3.75 |
| E224 | 510 | 28.347 | 3.80 |
| E225 | 511 | 31.093 | 4.16 |
| E226 | 512 | 12.493 | 1.67 |
| E227 | 513 | 30.280 | 4.06 |
| E228 | 514 | 25.293 | 3.39 |
| E117 | 403 | 7.467 | 1.00 |
| E120 | 406 | 23.427 | 3.14 |

As is obvious from the test results described above, each mRNA compound produced, after being added to the Hela cell lysate, a polypeptide encoded by a gene sequence in the eukaryotic cell translation system.

Test Example 11

(In Vitro Translation Reaction Test of mRNA Sample with Hela Cell Line)

The respective compounds shown in Tables 21 to 56 were evaluated for translation activity in vitro with Hela cell line. Transfection of each compound into the cell line and preparation of a cell lysate were performed in the same manner as in Test Example 7 (in vitro Translation Reaction Test of mRNA Sample with Hela Cell Line), and cell lysis was performed with iScript RT-qPCR Sample Preparation Reagent containing 2% protease inhibitor cocktail (for an animal cell extract).

A translation product in a cell lysate thus obtained was detected in the same manner as in the sandwich ELISA method described in Test Example 10 (Translation Reaction Test of mRNA Sample with Hela Cell Lysate). As results of the measurement, a translation product concentration (nM) in each translation reaction solution quantitatively determined with a calibration curve created based on the absorbances of the polypeptide preparation is shown in the following table:

TABLE 123

Concentration of Translation Product obtained from Compound

| Compound Name | SEQ ID NO: | Translation Product Concentration (nM) |
|---|---|---|
| E79 | 302 | 0.000 |
| E80 | 303 | 0.010 |
| E81 | 304 | 0.147 |

As is obvious from the test results, each mRNA having sugar modification produced, after being added to the Hela cell, a polypeptide encoded by a gene sequence, and the activity was more excellent than that of an mRNA having no sugar modification in the translated region.

Test Example 12

(Translation Reaction Test of mRNA Sample with Hela Cell Lysate)

The respective compounds shown in Tables 21 to 56 were evaluated for translation activity in a human cell system with 1-Step Human Coupled IVT Kit (manufactured by Thermo Fisher Scientific K.K., Catalog No. 88882). The translation reaction was performed under the same conditions as those employed in Test Example 2 (Translation Reaction Test of mRNA Sample with Hela Cell Lysate) under condition of a nucleic acid final concentration of 1 μM.

A translation product in a reaction solution after the translation reaction was detected in accordance with the sandwich ELISA method described in Test Example 6 (Translation Reaction Test of mRNA Sample with Hela Cell Lysate) in the same manner except that a peptide of SEQ ID NO: 541 (manufactured by Cosmo Bio Co., Ltd.) was used as a translation product polypeptide preparation. A translation product concentration (nM) in each translation reaction solution quantitatively determined with a calibration curve created based on the absorbances of the polypeptide preparation, and a relative amount of the translation product calculated assuming that the amount obtained from E82 having no sugar modification in the translated region is 1 are shown in Tables 124 to 133.

Translation Product Polypeptide Preparation:

(SEQ ID NO: 541)
NH2-MDYKDDDDKGGDYKDDDDKHHHHHH-COOH

TABLE 124

| Compound Name | SEQ ID NO: | Translation Product Concentration (nM) | Relative Amount of Translation Product |
|---|---|---|---|
| E82 | 305 | 2.427 | 1.00 |
| E84 | 307 | 24.560 | 10.12 |
| E122 | 408 | 17.427 | 7.18 |

TABLE 125

| Compound Name | SEQ ID NO: | Translation Product Concentration (nM) | Relative Amount of Translation Product |
|---|---|---|---|
| E82 | 305 | 20.067 | 1.00 |
| E84 | 307 | 130.000 | 6.48 |
| E85 | 308 | 75.867 | 3.78 |

TABLE 126

| Compound Name | SEQ ID NO: | Translation Product Concentration (nM) | Relative Amount of Translation Product |
|---|---|---|---|
| E127 | 413 | 5.473 | 3.93 |
| E128 | 414 | 4.367 | 3.14 |
| E129 | 415 | 2.943 | 2.11 |
| E130 | 416 | 4.874 | 3.50 |
| E131 | 417 | 5.633 | 4.05 |
| E132 | 418 | 4.076 | 2.93 |
| E133 | 419 | 4.005 | 2.88 |
| E134 | 420 | 4.515 | 3.24 |
| E135 | 421 | 4.956 | 3.56 |
| E136 | 422 | 1.973 | 1.42 |
| E137 | 423 | 2.191 | 1.57 |
| E138 | 424 | 4.254 | 3.06 |
| E139 | 425 | 4.375 | 3.14 |
| E140 | 426 | 4.238 | 3.04 |
| E141 | 427 | 4.327 | 3.11 |
| E142 | 428 | 3.403 | 2.44 |
| E143 | 429 | 3.230 | 2.32 |
| E82 | 305 | 1.392 | 1.00 |
| E84 | 307 | 7.319 | 5.26 |

TABLE 127

| Compound Name | SEQ ID NO: | Translation Product Concentration (nM) | Relative Amount of Translation Product |
|---|---|---|---|
| E144 | 430 | 7.639 | 3.94 |
| E145 | 431 | 3.165 | 1.63 |
| E146 | 432 | 5.721 | 2.95 |
| E147 | 433 | 16.501 | 8.50 |
| E148 | 434 | 14.451 | 7.45 |
| E149 | 435 | 19.020 | 9.80 |
| E150 | 436 | 14.615 | 7.53 |
| E151 | 437 | 16.500 | 8.50 |
| E152 | 438 | 6.457 | 3.33 |
| E153 | 439 | 12.027 | 6.20 |
| E82 | 305 | 1.941 | 1.00 |
| E84 | 307 | 10.832 | 5.58 |

TABLE 128

| Compound Name | SEQ ID NO: | Translation Product Concentration (nM) | Relative Amount of Translation Product |
|---|---|---|---|
| E154 | 440 | 26.333 | 12.91 |
| E155 | 441 | 11.240 | 5.51 |
| E156 | 442 | 5.000 | 2.45 |
| E82 | 305 | 2.040 | 1.00 |
| E84 | 307 | 29.707 | 14.56 |

TABLE 129

| Compound Name | SEQ ID NO: | Translation Product Concentration (nM) | Relative Amount of Translation Product |
|---|---|---|---|
| E157 | 443 | 15.827 | 9.27 |
| E158 | 444 | 4.107 | 2.41 |
| E159 | 445 | 7.720 | 4.52 |
| E160 | 446 | 22.453 | 13.16 |
| E161 | 447 | 19.747 | 11.57 |
| E162 | 448 | 19.760 | 11.58 |
| E163 | 449 | 15.920 | 9.33 |
| E164 | 450 | 17.173 | 10.06 |
| E165 | 451 | 20.120 | 11.79 |
| E166 | 452 | 16.627 | 9.74 |
| E167 | 453 | 10.533 | 6.17 |
| E82 | 305 | 1.707 | 1.00 |
| E84 | 307 | 15.947 | 9.34 |

TABLE 130

| Compound Name | SEQ ID NO: | Translation Product Concentration (nM) | Relative Amount of Translation Product |
|---|---|---|---|
| E168 | 454 | 17.867 | 7.44 |
| E169 | 455 | 18.093 | 7.54 |
| E170 | 456 | 8.267 | 3.44 |
| E171 | 457 | 16.120 | 6.72 |
| E172 | 458 | 3.120 | 1.30 |
| E173 | 459 | 5.373 | 2.24 |
| E174 | 460 | 18.480 | 7.70 |
| E175 | 461 | 3.667 | 1.53 |
| E176 | 462 | 12.493 | 5.21 |
| E177 | 463 | 10.653 | 4.44 |
| E82 | 305 | 2.400 | 1.00 |
| E84 | 307 | 14.893 | 6.21 |

TABLE 131

| Compound Name | SEQ ID NO: | Translation Product Concentration (nM) | Relative Amount of Translation Product |
|---|---|---|---|
| E178 | 464 | 9.347 | 4.35 |
| E179 | 465 | 7.573 | 3.53 |
| E180 | 466 | 5.493 | 2.56 |
| E181 | 467 | 5.120 | 2.39 |
| E182 | 468 | 10.773 | 5.02 |
| E183 | 469 | 10.693 | 4.98 |
| E184 | 470 | 7.800 | 3.63 |
| E185 | 471 | 9.453 | 4.40 |
| E186 | 472 | 8.680 | 4.04 |
| E82 | 305 | 2.147 | 1.00 |
| E84 | 307 | 8.680 | 4.04 |

TABLE 132

| Compound Name | SEQ ID NO: | Translation Product Concentration (nM) | Relative Amount of Translation Product |
|---|---|---|---|
| E229 | 515 | 9.867 | 3.15 |
| E230 | 516 | 17.387 | 5.55 |
| E231 | 517 | 14.387 | 4.59 |
| E232 | 518 | 17.427 | 5.56 |
| E233 | 519 | 16.107 | 5.14 |
| E234 | 520 | 15.667 | 5.00 |
| E235 | 521 | 16.907 | 5.40 |
| E236 | 522 | 16.680 | 5.32 |
| E237 | 523 | 14.627 | 4.67 |
| E238 | 524 | 15.840 | 5.06 |
| E239 | 525 | 16.160 | 5.16 |
| E240 | 526 | 14.840 | 4.74 |
| E241 | 527 | 16.653 | 5.31 |
| E242 | 528 | 17.760 | 5.67 |
| E243 | 529 | 15.000 | 4.79 |
| E246 | 532 | 0.000 | 0.00 |

TABLE 132-continued

| Compound Name | SEQ ID NO: | Translation Product Concentration (nM) | Relative Amount of Translation Product |
|---|---|---|---|
| E82 | 305 | 3.133 | 1.00 |
| E84 | 307 | 20.987 | 6.70 |

TABLE 133

| Compound Name | SEQ ID NO: | Translation Product Concentration (nM) | Relative Amount of Translation Product |
|---|---|---|---|
| E82 | 305 | 3.040 | 1.00 |
| E84 | 307 | 26.427 | 8.69 |
| E122 | 408 | 10.093 | 3.32 |
| E243 | 529 | 16.107 | 5.30 |
| E244 | 530 | 7.813 | 2.57 |
| E245 | 531 | 7.987 | 2.63 |

As is obvious from the test results described above, each mRNA compound having sugar modification produced, after being added to the Hela cell lysate, a polypeptide encoded by a gene sequence in the eukaryotic cell translation system.

Test Example 13

(In Vitro Translation Reaction Test of mRNA Sample with Hela Cell Line)

The respective compounds shown in Tables 21 to 56 were evaluated for translation activity in vitro with Hela cell line. Transfection of each compound into the cell line and preparation of a cell lysate were performed in the same manner as in Test Example 7 (in vitro Translation Reaction Test of mRNA Sample with Hela Cell Line), and cell lysis was performed with iScript RT-qPCR Sample Preparation Reagent containing 2% protease inhibitor cocktail (for an animal cell extract).

A translation product in a cell lysate thus obtained was detected by a method similar to the sandwich ELISA method described in Test Example 12 (Translation Reaction Test of mRNA Sample with Hela Cell Lysate). As results of the measurement, a translation product concentration (nM) in each translation reaction solution quantitatively determined with a calibration curve created based on the absorbances of the polypeptide preparation is shown in the following table:

TABLE 134

| Concentration of Translation Product obtained from Compound | | |
|---|---|---|
| Compound Name | SEQ ID NO: | Translation Product Concentration (nM) |
| E82 | 305 | 0.117 |
| E84 | 307 | 3.277 |
| E85 | 308 | 0.930 |

As is obvious from the test results described above, each mRNA having sugar modification produced, after being added to the Hela cell, a polypeptide encoded by a gene sequence, and the activity was more excellent than that of an mRNA having no sugar modification.

Test Example 14

(Translation Reaction in Eukaryotic Cell System: Translation Reaction Test with Rabbit Erythrocyte Lysate)

The respective compounds shown in Tables 21 to 56 were evaluated for translation activity in a eukaryotic cell system with Rabbit-Reticulocyte-Lysate-System-Nuclease-Treated Kit. The translation reaction was performed by the same method as that employed in Test Example 2 (Translation Reaction in Eukaryotic Cell System: Translation Reaction Test with Rabbit Erythrocyte Lysate).

A translation product in a reaction solution obtained after the translation reaction was detected by the following sandwich ELISA method: First, Anti-Human EGF antibody (manufactured by Peprotech, Catalog No. 500-P45) was diluted with 0.1 M carbonate buffer (pH 9.4) to 3 μg/mL, and the resultant was dispensed into a 96 well ELISA plate (manufactured by Nunc Inc.) by 50 μL per well, and was allowed to stand still at 4° C. overnight, and thus, a plate in which the antibody was immobilized was produced. Subsequently, the plate was washed with Tris Buffered Saline with Tween 20 diluted 1× concentration with purified water (hereinafter referred to as the washing solution), and then, a washing solution obtained by diluting bovine serum albumin to a final concentration of 3% (hereinafter referred to as the blocking solution) was dispensed thereinto by 200 μL per well, and the resultant was allowed to stand still at room temperature for 1 hour. After washing the plate with the washing solution, the translation reaction solution diluted 100 fold with the blocking solution was dispensed thereinto by 50 μL per well, and the resultant was allowed to stand still at room temperature for 1 hour. After washing the plate with the washing solution, Monoclonal ANTI-FLAG M2-Peroxidase (HRP) Ab produced in mouse (manufactured by SIGMA, Catalog Antibody A8592-1MG) diluted 10,000 fold with the blocking solution was dispensed thereinto by 50 μL per well, and the resultant was allowed to stand still at room temperature for 1 hour. After washing the plate with the washing solution, 1-Step Ultra TMB-ELISA (manufactured by Thermo Fisher Scientific K.K., Catalog No. 34028) was dispensed thereinto by 50 μL per well, and the resultant was allowed to stand still at room temperature for several minutes. Thereafter, 0.5 M sulfuric acid (manufactured by Wako Pure Chemical Industries Ltd.) was dispensed thereinto by 50 μL per well to stop the reaction, and then, absorbances at a measurement wavelength of 450 nm and a reference wavelength of 570 nm were measured with an absorptiometer (manufactured by BIORAD). An absorbance obtained by measuring each translation reaction solution (obtained by subtracting an absorbance at the reference wavelength from an absorbance at the measurement wavelength) is shown in the following table:

TABLE 135

Absorbance of Compound Measured by ELISA

| Compound Name | SEQ ID NO: | Absorbance |
|---|---|---|
| E5 | 79 | 1.19 |
| E101 | 354 | 1.25 |
| E102 | 358 | 1.21 |
| E103 | 362 | 1.30 |
| E104 | 366 | 1.02 |
| E105 | 370 | 1.25 |

As is obvious from the test results described above, each mRNA compound having sugar modification produced, after being added to the rabbit erythrocyte lysate, a FLAG-EGF peptide encoded by a gene sequence in the eukaryotic cell translation system.

Test Example 15

(Translation Reaction Test of mRNA Sample with Hela Cell Lysate)

The respective compounds shown in Tables 21 to 56 were evaluated for translation activity in a human cell system with 1-Step Human Coupled IVT Kit (manufactured by Thermo Fisher Scientific K.K., Catalog No. 88882). The translation reaction was performed under the same conditions as those employed in Test Example 2 (Translation Reaction Test of mRNA Sample with Hela Cell Lysate) under condition of a nucleic acid final concentration of 1 μM.

A translation product in a reaction solution after the translation reaction was detected in accordance with the sandwich ELISA method described in Test Example 14 (Translation Reaction in Eukaryotic Cell System: Translation Reaction Test with Rabbit Erythrocyte Lysate) in the same manner except that the translation reaction solution was diluted 20 fold with the blocking solution. An absorbance obtained by measuring each translation reaction solution (obtained by subtracting an absorbance at the reference wavelength from an absorbance at the measurement wavelength) is shown in the following table:

TABLE 136

Absorbance of Compound Measured by ELISA

| Compound Name | SEQ ID NO: | Absorbance |
|---|---|---|
| E5 | 79 | 1.12 |
| E101 | 354 | 1.41 |
| E102 | 358 | 1.37 |
| E103 | 362 | 1.49 |
| E104 | 366 | 1.37 |
| E105 | 370 | 1.44 |

As is obvious from the test results described above, each mRNA compound having sugar modification produced, after being added to the Hela cell lysate, a FLAG-EGF peptide encoded by a gene sequence in the eukaryotic cell translation system.

Test Example 16

(In Vitro Translation Reaction Test of mRNA Sample with Hela Cell Line)

The respective compounds shown in Tables 21 to 56 were evaluated for translation activity in vitro with Hela cell line. Transfection of each compound into the cell line and preparation of a cell lysate were performed in the same manner as in Test Example 7 (in vitro Translation Reaction Test of mRNA Sample with Hela Cell Line), and cell lysis was performed with iScript RT-qPCR Sample Preparation Reagent containing 2% protease inhibitor cocktail (for an animal cell extract).

A translation product in a cell lysate thus obtained was detected in accordance with the sandwich ELISA method described in Test Example 14 (Translation Reaction in Eukaryotic Cell System: Translation Reaction Test with Rabbit Erythrocyte Lysate) in the same manner except that the cell lysate was diluted 30 fold with the blocking solution. An absorbance obtained by measuring each translation reaction solution (obtained by subtracting an absorbance at the reference wavelength from an absorbance at the measurement wavelength) is shown in the following table:

TABLE 137

| Absorbance of Compound Measured by ELISA | | |
|---|---|---|
| Compound Name | SEQ ID NO: | Absorbance |
| E5 | 79 | 0.01 |
| E101 | 354 | 0.03 |
| E102 | 358 | 0.11 |
| E104 | 366 | 0.11 |
| E105 | 370 | 0.04 |

As is obvious from the test results described above, each mRNA compound having sugar modification produced, after being added to the Hela cell, a FLAG-EGF peptide encoded by a gene sequence in the eukaryotic cell translation system, and the activity was more excellent than that of an mRNA having no sugar modification.

Test Example 17

(Translation Reaction in Eukaryotic Cell System: Translation Reaction Test with Rabbit Erythrocyte Lysate)

The respective compounds shown in Tables 21 to 56 were evaluated for translation activity in a eukaryotic cell system with Rabbit-Reticulocyte-Lysate-System-Nuclease-Treated Kit. The translation reaction was performed by the same method as that employed in Test Example 2 (Translation Reaction in Eukaryotic Cell System: Translation Reaction Test with Rabbit Erythrocyte Lysate).

A translation product in a reaction solution after the translation reaction was detected in accordance with the sandwich ELISA method described in Test Example 6 (Translation Reaction Test of mRNA Sample with Hela Cell Lysate) in the same manner except that a peptide of SEQ ID NO: 542 (manufactured by Cosmo Bio Co., Ltd.) was used as a translation product polypeptide preparation. A translation product concentration (nM) in each translation reaction solution quantitatively determined with a calibration curve created based on the absorbances of the polypeptide preparation, and a relative amount of the translation product calculated assuming that the amount obtained from E6 having no sugar modification in the translated region is 1 are shown in the following table:

Translation Product Polypeptide Preparation:

```
                                        (SEQ ID NO: 542)
NH2-MDYKDDDDKIIDYKDDDDKGGDYKDDDDKSIINFEKLHHHHHH-

COOH
```

TABLE 138

| Concentration of Translation Product obtained from Compound | | | |
|---|---|---|---|
| Compound Name | SEQ ID NO: | Translation Product Concentration (nM) | Relative Amount of Translation Product |
| E6 | 83 | 1.333 | 1.00 |
| E106 | 374 | 2.800 | 2.10 |
| E107 | 377 | 4.467 | 3.35 |
| E108 | 380 | 5.500 | 4.13 |
| E109 | 383 | 4.433 | 3.33 |

As is obvious from the test results described above, each mRNA compound having sugar modification produced, after being added to the rabbit erythrocyte lysate, a peptide encoded by a gene sequence in the eukaryotic cell translation system.

Test Example 18

(Translation Reaction Test of mRNA Sample with Hela Cell Lysate)

The respective compounds shown in Tables 21 to 56 were evaluated for translation activity in a human cell system with 1-Step Human Coupled IVT Kit (manufactured by Thermo Fisher Scientific K.K., Catalog No. 88882). The translation reaction was performed under the same conditions as those employed in Test Example 2 (Translation Reaction Test of mRNA Sample with Hela Cell Lysate) under condition of a nucleic acid final concentration of 1 μM.

A translation product in a reaction solution after the translation reaction was detected in accordance with the sandwich ELISA method described in Test Example 17 (Translation Reaction in Eukaryotic Cell System: Translation Reaction Test with Rabbit Erythrocyte Lysate) in the same manner except that the translation reaction solution was diluted 10 fold with the blocking solution. A translation product concentration (nM) in each translation reaction solution quantitatively determined with a calibration curve created based on the absorbances of the polypeptide preparation, and a relative amount of the translation product calculated assuming that the amount obtained from E6 having no sugar modification in the translated region is 1 are shown in the following table:

TABLE 139

| Concentration of Translation Product obtained from Compound | | | |
|---|---|---|---|
| Compound Name | SEQ ID NO: | Translation Product Concentration (nM) | Relative Amount of Translation Product |
| E6 | 83 | 0.500 | 1.00 |
| E106 | 374 | 0.120 | 0.24 |
| E107 | 377 | 0.867 | 1.73 |
| E108 | 380 | 0.507 | 1.01 |
| E109 | 383 | 0.407 | 0.81 |

As is obvious from the test results described above, each mRNA compound having sugar modification produced, after being added to the Hela cell lysate, a peptide encoded by a gene sequence in the eukaryotic cell translation system.

Test Example 19

(Test of Stability in Serum of mRNA Sample)

The respective compounds shown in Tables 21 to 56 were evaluated for nucleic acid stability in serum with a commercially available mouse serum (Takara Bio Inc., Catalog No. 2311B, Lot No. AJ10759A). First, the mouse serum was diluted 15 fold with UltraPure™ DNase/RNase-Free Distilled Water (DW) (Invitrogen, Catalog No. 10977-015) to prepare a diluted serum solution. Each compound was diluted to a final concentration of 5 μM with THE RNA storage solution (Thermo Fisher Scientific K.K., Catalog No. AM7001).

As a sample before enzymatic reaction (0 min), 10.5 μL of a mixed solution of 8 μL of the diluted serum solution and 2.5 μL of 6 U/μL Ribonuclease Inhibitor (Takara Bio Inc., Catalog No. 2311B), and 2 μL of 5 μM mRNA were added to another 96 well PCR plate, and the resultant was stored at −30° C. As a sample for enzymatic reaction, 28 μL of the diluted serum solution and 7 μL of 5 μM mRNA were added to and well mixed in another 96 well PCR plate. The resultant was dispensed into four fresh 96 well PCR plates by 10 μL each, a reaction was caused in the respective plates at 37° C. respectively for prescribed times (5 min, 15 min, 30 min, and 60 min), 2.5 μL of 6 U/μL Rnase inhibitor was added thereto, and the resultant was stored at −30° C. until measurement.

A remaining amount of mRNA in a reaction solution after the enzymatic reaction was detected by RT-qPCR method as follows: First, for a calibration curve, the compound R18 was used for the compounds of Table 140 and the corresponding compounds were used for the compounds of Table 141 to make dilution series by obtaining 11 concentrations from 4 μM with 4-fold dilution with THE RNA storage solution. 2.5 μL of each of samples for the calibration curve and after the enzymatic reaction was diluted 1071 fold by using DW to which Ribonuclease Inhibitor had been added to a final concentration of 0.2 U/mL. A reverse transcription product cDNA was produced using 5 μL of the diluted sample and 1 μL of 2 μM RT primer (Sigma Aldrich Co.) with a TaqMan Micro RNA RT kit (Thermo Fisher Scientific K.K., Catalog No. 4366597). The reaction was performed at a reaction temperature of 16° C. for 30 minutes, then at 42° C. for 30 minutes, and then at 85° C. for 5 minutes. 5 μL of cDNA, 10 μL of TaqMan Gene Expression Master Mix, 0.28 μL of Fw primer (Sigma Aldrich Co.), 0.33 μL of Rv primer (Sigma Aldrich Co.), 0.38 μL of TaqMan MGB Probe (Thermo Fisher Scientific K.K., Catalog No. 4316033), and 4.01 μL of distilled water were mixed to perform qPCR measurement. As an apparatus, Quantstudio12K Flex (Applied Biosystems) was used. The DNA sequences of the used primers and Taqman MGB probe were as follows. As results of the measurement, a concentration of each compound in each sample was quantitatively determined by using a calibration curve based on a CT value of a preparation, and a relative remaining amount with respect to the amount before the enzymatic reaction (0 min) was calculated, which is shown in the following tables.

```
RT primer:
                                  (SEQ ID NO: 75)
5'-TCAGTGGTGGTGGTGGTGGTGTTTG-3'

Fw primer:
                                  (SEQ ID NO: 76)
5'-ATCTTGTCGTCGTCGTCCTT-3'

Rv primer:
                                  (SEQ ID NO: 77)
5'-GAATACAAGCTACTTGTTCTTTT-3'
```

-continued

```
Taqman MGB Probe:
                                  (SEQ ID NO: 78)
5'-CAGCCACCATG-3'
```

TABLE 140

Remaining Amount of Compound Relative to Amount before Enzymatic Reaction (0 min) at Each Reaction Time

| Compound Name | SEQ ID NO: | 0 min | 1 5 min | 30 min | 60 min |
|---|---|---|---|---|---|
| R18 | 72 | 1.000 | 0.005 | 0.003 | 0.003 |
| E1 | 1 | 1.000 | 0.106 | 0.004 | 0.004 |
| R6 | 33 | 1.000 | 0.002 | 0.004 | 0.003 |
| E2 | 5 | 1.000 | 0.195 | 0.005 | 0.005 |
| E3 | 8 | 1.000 | 0.227 | 0.005 | 0.003 |

TABLE 141

Remaining Amount of Compound Relative to Amount before Enzymatic Reaction (0 min) at Each Reaction Time

| Compound Name | SEQ ID NO: | 0 min | 5 min | 1 5 min | 30 min |
|---|---|---|---|---|---|
| R18 | 72 | 1.000 | 0.000 | 0.000 | 0.000 |
| E1 | 1 | 1.000 | 0.185 | 0.000 | 0.000 |
| E4 | 11 | 1.000 | 0.019 | 0.000 | 0.000 |
| E21 | 128 | 1.000 | 0.749 | 0.009 | 0.000 |
| E48 | 209 | 1.000 | 0.026 | 0.000 | 0.000 |
| E110 | 386 | 1.000 | 0.017 | 0.006 | 0.000 |

As is obvious from the test results described above, an mRNA having sugar modification was improved in degradation resistance in serum as compared with an mRNA having no sugar modification.

Test Example 20 (Translation Reaction of VEGF Protein)

<Synthesis of Comparative Compound RN>

Sequence information of materials (polynucleotides) used in synthesis of a comparative compound RN to be translated to VEGF protein is as follows. Each nucleotide N in the table indicates an RNA, N(M) indicates a 2'-O-methyl modified RNA, N(F) indicates a 2'-F modified RNA, N(MOE) indicates a 2'-O-methoxyethyl modified RNA, and dN indicates a DNA.

TABLE 142

| Compound Name | Sequence (5' to 3') | SEQ ID NO: |
|---|---|---|
| FW PRIMER | dAdAdGdCdTdAdAdTdAdCdGdAdCdTdCdAdCdTdAdTdAdGdGdGdTdGdCd AdTdTdGdGdAdGdCdCdTdTdGdCdCdTdTdGdCdTdGdCdTdC | 543 |
| RV PRIMER1 | dCdTdAdGdAdTdTdTdTdTdTdTdTdTdTdTdTdTdTdTdTdTdTdTdTdTdTd TdTdTdTdTdTdTdTdTdTdTdTdTdTdTdTdTdTdTdTdTdTdTdTdTdTdTdT dTdTdTdTdTdTdTdTdTdTdTdTdTdTdTdTdTdTdTdTdTdTdTdTdTdTdTd TdTdTdTdTdTdTdTdTdTdTdTdTdTdTdTdTdTdTdGdCdCdGdCdCdCdAd CdTdCdAdGdAdCdTdTdTdAdTdTdCdAdAdAdGdAdCdC | 544 |
| 5' end polynucleotide sequence RN-1 | GGGAAAUAAGAGAGAAAAGAAGAGUAAGAAGAAAUAUAAGAGCCACCA UGAACUUUCUGCUGUCUU | 545 |

TABLE 142-continued

| Compound Name | Sequence (5' to 3') | SEQ ID NO: |
|---|---|---|
| Artificially Synthesized Gene Sequence GN | TTGGACCCTCGTACAGAAGCTAATACGACTCACTATAGGGAAATAAGAG AGAAAAGAAGAGTAAGAAGAAATATAAGAGCCACCATGAACTTTCTGCT GTCTTGGGTGCATTGGAGCCTTGCCTTGCTGCTCTACCTCCACCATGCC AAGTGGTCCCAGGCTGCACCCATGGCAGAAGGAGGAGGGCAGAATCAT CACGAAGTGGTGAAGTTCATGGATGTCTATCAGCGCAGCTACTGCCATC CAATCGAGACCCTGGTGGACATCTTCCAGGAGTACCCTGATGAGATCG AGTACATCTTCAAGCCATCCTGTGTGCCCCTGATGCGATGCGGGGGCT GCTGCAATGACGAGGGCCTGGAGTGTGTGCCCACTGAGGAGTCCAACA TCACCATGCAGATTATGCGGATCAAACCTCACCAAGGCCAGCACATAG GAGAGATGAGCTTCCTACAGCACAACAAATGTGAATGCAGACCAAAGA AAGATAGAGCAAGACAAGAAAATCCCTGTGGGCCTTGCTCAGAGCGGA GAAAGCATTTGTTTGTACAAGATCCGCAGACGTGTAAATGTTCCTGCAA AAACACAGACTCGCGTTGCAAGGCGAGGCAGCTTGAGTTAAACGAACG TACTTGCAGATGTGACAAGCCGAGGCGGTGATAATAGGCTGGAGCCTC GGTGGCCATGCTTCTTGCCCCTTGGGCCTCCCCCCAGCCCCTCCTCCC CTTCCTGCACCCGTACCCCCGTGGTCTTTGAATAAAGTCTGA | 546 |
| Template DNA-A | dGdGdCdTdCdCdAdAdTdGdCdAdCdCdCdAdAdGdAdCdAdGdCdAdGdAdA dAdGdT | 547 |

Through the following series of operations, the comparative compound RN was obtained.

(Preparation of Double-Stranded DNA by PCR Reaction and Preparation of 3' End Side Polynucleotide Fragment by In Vitro Transcription)

As a plasmid DNA, one obtained by inserting, into Sma I site of a commercially available pUC19 vector, an artificially synthesized gene sequence GN of SEQ ID NO: 546 shown above was used (manufactured by Fasmac Co., Ltd.).

The plasmid DNA, a FW primer and a RV primer were used to perform PCR. Final concentrations in a PCR solution were as follows: A template DNA: 0.2 ng/μL, dNTP: 250 μM, the primer: 0.3 μM, PrimeSTAR HS DNA Polymerase (Takara): 0.025 U/μL, and PrimeSTAR Buffer ($Mg^{2+}$ Plus) (Takara): 1×. A temperature cycle was as follows: 94° C. for 5 min., and [98° C. for 10 sec., 55° C. for 30 sec., and 72° C. for 60 sec.]×30 cycles. The resultant was roughly purified by phenol chloroform extraction and isopropanol precipitation. Subsequently, the template plasmid was degraded and removed by DpnI treatment. Final concentrations in the resultant reaction solution were: a PCR product: 3.43 μg/μL, Dpn I (Takara): 1 U/μL, and T buffer (Takara): 1×, and the resultant was incubated at 37° C. for 1 hour. The resultant was roughly purified by phenol chloroform extraction and isopropanol precipitation.

Subsequently, a transcription reaction with T7 RNA polymerase was performed. Final concentrations in the resultant reaction solution were as follows: DNA: 10 ng/μL, DTT: 5 mM, ATP, CTP, and UTP: 2 mM each, GMP: 2 mM, GTP: 0.5 mM, T7 RNA polymerase (Takara): 2.5 U/μL, T7 RNA Polymerase buffer (Takara): 1×, and RNase Inhibitor, Murine (NEB): 0.2 U/μL. The resultant was incubated at 37° C. for 2 hours. Subsequently, DNase (recombinant, RNase-free, Takara) was added thereto to a final concentration of 0.1 U/μL, followed by incubation at 37° C. for 30 minutes. The resultant was roughly purified by phenol chloroform extraction and isopropanol precipitation to obtain a 3' end side polynucleotide fragment RN-2.

(Preparation of RNA Ligation Product by RNA Ligation)

A ligation reaction with RNA ligase 2 was performed using a 3' end polynucleotide fragment RN-1 obtained by chemical synthesis in accordance with an ordinary method, an RNA fragment RN-2 obtained by in vitro transcription, and a template DNA-A. Final concentrations were RN-1: 2 μM, RN-2: 2 μM, DNAN: 4 μM, PEG8000: 10% (v/v), T4 RNA ligase 2 (NEB): 1 U/μL, T4 RNA ligase 2 buffer (NEB): 1×, and RNase inhibitor Murine (NEB): 1 U/μL. Substrate and reagents except for PEG8000, T4 RNA ligase 2, and RNase inhibitor were added to a tube, the resultant was heated at 90° C. for 3 minutes, and the heat was naturally released to room temperature. The rest of the reagents and enzyme was added thereto, followed by incubation at 45° C. for 1 hour. DNase was added thereto in a final concentration of 0.33 U/μL, followed by incubation at 37° C. for 15 minutes. The resultant was roughly purified by phenol-chloroform extraction and isopropanol precipitation to obtain a ligated RNA. A reaction sample was analyzed by dPAGE (5% acrylamide, 7 M urea). Gel purification was performed as follows: After performing electrophoresis with dPAGE (6% acrylamide, 7.5 M urea, 25% formamide), a corresponding band was cut out, and subjected to extraction with MQ water for 12 hours. Through a treatment with Amicon 10K (Merck Millipore Corp.) and isopropanol precipitation, a gel extraction product was obtained.

(Sequence Analysis of Ligating Portion of RNA Ligation Product)

Through the following series of operations, the sequence of a ligating portion of an RNA ligation product RN was analyzed with Smarter RACE 5'3' Kit (manufactured by Takara Bio Inc., Catalog No. 634859. First, 1 μL of the RN prepared to 100 ng/μL was taken out to be mixed with 1 μL of 5' CDS Primer A and 9 μL of Nuclease-free water, and the resultant was heated at 72° C. for 4 minutes, and then cooled at 4° C. for 2 minutes. The resultant was mixed with 1 μL of SMARTER II A Oligo, 4 μL of 5× First Strand Buffer, 0.5 μL of 100 mM DTT, 1 μL of 20 mM dNTPs, 0.5 μL of 40 U/μL RNase Inhibitor, and 2 μL of SMARTScribe Reverse Transcriptase, the resultant was heated at 42° C. for 90 minutes and at 72° C. for 10 minutes, and then cooled at 4° C., and thereafter, 240 μL of TE Buffer was added to and mixed with the resultant to synthesize a template cDNA. Subsequently, the thus obtained template cDNA was used to perform PCR reaction as follows: Specifically, 2.5 μL of the template cDNA, 5 μL of 10×UPM, 0.1 μL of 100 μM RV primer 2 (SEQ ID NO: 548), 25 μL of SeqAmp Buffer, 1 μL of SeqAmp DNA polymerase, and 16.4 μL of Nuclease-free water were mixed, and a thermal cycler was used to heat the resultant at 94° C. for 30 seconds, then a cycle of heating at 68° C. for 30 seconds and at 72° C. for 60 seconds was repeated 20 times, and thereafter, the resultant was cooled at 4° C. The thus obtained PCR product was subjected to electrophoresis in 1.5% agarose-TAE gel, a corresponding band was cut out, and the resultant PCR product was purified with QIAquick Gel Extraction Kit (manufactured by QIAGEN, Catalog No. 28704). 1 μL of the resultant PCR product was mixed with 0.5 μL of TOPO vector included in Zero Blunt TOPO PCR Cloning Kit for Sequencing (manufactured by Invitrogen, Catalog No. 45-0031), 0.5 μL of Salt solution and 1 μL of Nuclease-free water, followed by reaction at room temperature for 5 minutes. The resultant reaction product was transformed into Competent Quick DH5α (manufactured by Toyobo Co., Ltd., Catalog No. DNA-913), and the resultant was seeded in LB agar medium plate containing 100 μg/mL ampicillin, and was cultured at 37° C. overnight to obtain a single colony. The single colony was inoculated into LB liquid medium containing 100 μg/mL ampicillin to be cultured at 37° C. overnight, and from the thus obtained *E. coli*, a plasmid DNA was extracted with PureYield Plasmid Miniprep System (manufactured by Promega Corp., Catalog No. A1222).

500 ng of the thus obtained plasmid DNA was mixed with 6.4 pmol of sequence primer (M13FW or M13RV respectively of SEQ ID NO: 549 or 550), the resultant was prepared to 14 μL with Nuclease-free water, and a request was made to Fasmac Co., Ltd. to subject the resultant to capillary sequencing based on the Sanger method. As a result of sequencing from three independent single colonies, it was confirmed that the sequence of the ligating portion of the RNA ligation product RN accords with that of a corresponding portion in the gene sequence of SEQ ID NO: 546.

RV primer 2:
SEQ ID NO: 548
5'-GATTACGCCAAGCTTTGG CTTGAAGATGTA
CTCGATCTCATCAGG-3'

Sequence primer M13FW:
SEQ ID NO: 549
5'-CTCGATCTCATCAGG-3'

Sequence primer M13RV:
SEQ ID NO: 550
5'-CAGGAAACAGCTATGAC-3'

<Synthesis of Comparative Compound RN'>

Sequence information of materials (polynucleotides) used in synthesis of a comparative compound RN' to be translated to VEGF protein is as follows. Each nucleotide N in the table indicates an RNA, N(M) indicates a 2'-O-methyl modified RNA, N(F) indicates a 2'-F modified RNA, N(MOE) indicates a 2'-O-methoxyethyl modified RNA, and dN indicates a DNA.

TABLE 143

| Compound Name | Sequence (5' to 3') | SEQ ID NO: |
|---|---|---|
| 5' end polynucleotide sequence RN'-1 | GGGAAAUAAGAGAGAAAAGAAGAGUAAGAAGAAAUAUAAGAGCCACCA UGAACUUUCUGCUGUCUU | 551 |
| Artificially Synthesized Gene Sequence GN' | AATTCAGTACTTAATACGACTCACTATAGGGTGCATTGGAGCCTTGCCT TGCTGCTCTACCTCCACCATGCCAAGTGGTCCCAGGCTGCACCCATGG CAGAAGGAGGAGGGCAGAATCATCACGAAGTGGTGAAGTTCATGGATG TCTATCAGCGCAGCTACTGCCATCCAATCGAGACCCTGGTGGACATCTT CCAGGAGTACCCTGATGAGATCGAGTACATCTTCAAGCCATCCTGTGTG CCCCTGATGCGATGCGGGGGCTGCTGCAATGACGAGGGCCTGGAGTGT GTGCCCACTGAGGAGTCCAACATCACCATGCAGATTATGCGGATCAAA CCTCACCAAGGCCAGCACATAGGAGAGATGAGCTTCCTACAGCACAAC AAATGTGAATGCAGACCAAAGAAAGATAGAGCAAGACAAGAAAATCCCT GTGGGCCTTGCTCAGAGCGGAGAAAGCATTTGTTTGTACAAGATCCGC AGACGTGTAAATGTTCCTGCAAAAACACAGACTCGCGTTGCAAGGCGA GGCAGCTTGAGTTAAACGAACGTACTTGCAGATGTGACAAGCCGAGGC GGTGATAATAGGCTGGAGCCTCGGTGGCCATGCTTCTTGCCCCTTGGG CCTCCCCCCAGCCCCTCCTCCCCTTCCTGCACCCGTACCCCCGTGGTC TTTGAATAAAGTCTGAGTGGGCGGCAAAAAAAAAAAAAAAAAAAAAAAA AAAAAAAAAAAAAAAAAAAAAAAAAAAAAAAAAAAAAAAAAAAAAAAAA AAAAAAAAAAAAAAAAAAAAAAAAAAT | 552 |
| Template DNA-B | dGdGdCdTdCdCdAdAdTdGdCdAdCdCdCdAdAdGdAdCdAdGdCdAd GdAdAdAdGdT | 553 |

Through the following series of operations, the comparative compound RN' was obtained.

(Preparation of Linearized Plasmid DNA and Preparation of RNA Fragment by In Vitro Transcription)

As a plasmid DNA, one obtained by inserting, into EcoRV site and XbaI site of a commercially available pUC19 vector, an artificially synthesized gene sequence GN' of SEQ ID NO: 552 was used (manufactured by Genewiz Inc.). The plasmid DNA was linearized with restriction enzyme XbaI. Final concentrations in the resultant reaction solution were: the plasmid DNA: 20 ng/μL, XbaI (Takara): 0.75 U/μL, M buffer (Takara): 1×, and BSA: 0.01%, and the resultant was incubated at 37° C. for 1 hour. The resultant was roughly purified by phenol chloroform extraction and isopropanol precipitation. The thus obtained linearized DNA was used to perform a transcription reaction. Final concentrations in the resultant reaction solution were as follows: DNA: 10 ng/μL, DTT: 5 mM, ATP, CTP, and UTP: 2 mM each, GMP: 2 mM, GTP: 0.5 mM, T7 RNA polymerase (Takara): 2.5 U/μL, T7 RNA Polymerase buffer (Takara): 1×, and RNase Inhibitor, Murine (NEB): 0.2 U/μL. The resultant was incubated at 37° C. for 2 hours. Subsequently, DNase (recombinant, RNase-free, Takara) was added thereto to a final concentration of 0.1 U/μL, followed by incubation at 37° C. for 30 minutes. The resultant was roughly purified by phenol chloroform extraction and isopropanol precipitation to obtain a 3' end side polynucleotide fragment RN'-2.

(Preparation of RNA Ligation Product by RNA Ligation)

A ligation reaction with RNA ligase 2 was performed using a 5' end polynucleotide fragment RN'-1 obtained by chemical synthesis in accordance with an ordinary method, a 3' end polynucleotide fragment RN'-2 obtained by in vitro transcription, and a template DNA-B. Final concentrations were RN-1: 2 μM, RN-2: 2 μM, DNAN: 4 μM, PEG8000: 10% (v/v), T4 RNA ligase 2 (NEB): 1 U/μL, T4 RNA ligase 2 buffer (NEB): 1×, and RNase inhibitor Murine (NEB): 1 U/μL. Substrate and reagents except for PEG8000, T4 RNA ligase 2, and RNase inhibitor were added to a tube, the resultant was heated at 90° C. for 3 minutes, and the heat was naturally released to room temperature. The rest of the reagents and enzyme was added thereto, followed by incubation at 45° C. for 1 hour. DNase was added thereto in a final concentration of 0.33 U/μL, followed by incubation at 37° C. for 15 minutes. The resultant was roughly purified by phenol-chloroform extraction and isopropanol precipitation to obtain a ligated RNA. A reaction sample was analyzed by dPAGE (5% acrylamide, 7 M urea). Gel purification was performed as follows: After performing electrophoresis with dPAGE (6% acrylamide, 7.5 M urea, 25% formamide), a corresponding band was cut out, and subjected to extraction with MQ water for 12 hours. Through a treatment with Amicon 10K (Merck Millipore Corp.) and isopropanol precipitation, a gel extraction product was obtained.

<Synthesis of Compound EN Having Sugar Modification>

Sequence information of materials (polynucleotides) used in synthesis of a compound EN to be translated to VEGF protein is as follows. Each nucleotide N in the table indicates an RNA, N(M) indicates a 2'-O-methyl modified RNA, N(F) indicates a 2'-F modified RNA, N(MOE) indicates a 2'-O-methoxyethyl modified RNA, and dN indicates a DNA.

TABLE 144

| Compound Name | Sequence (5' to 3') | SEQ ID NO: |
|---|---|---|
| EN-1 | G(MOE)G(MOE)G(MOE)A(MOE)A(MOE)A(MOE) UAA(F)GAG(F)AGA(F)AAA(F)GAA(F)GAG(F) UAA(F)GAA(F)GAA(F)AUA(F)UAA(F)GAG(F) CCA(F)CCA(F)UGA(F)ACU(F)UUC(F)UGC(F) UGU(F)CUU | 554 |
| Template DNA-C | dGdGdCdTdCdCdAdAdTdGdCdAdCdCdCdAdAd GdAdCdAdGdCdAdGdAdAdAdGdT | 555 |

Through the following series of operations, the compound EN having sugar modification was obtained.

(Preparation of Linearized Plasmid DNA and Preparation of RNA Fragment by In Vitro Transcription)

A 3' side fragment was obtained by the same method as that employed for preparing the RN'-2.

(Preparation of RNA Ligation Product by RNA Ligation)

RNA fragment EN-1 and RNA fragment RN'-2 obtained by chemical synthesis, and a template DNA-C were used to perform a ligation reaction with RNA ligase 2. Final concentrations were: EN-1: 2 μM, RN'-2: 2 μM, template DNA: 4 μM, PEG 8000: 10% (v/v), T4 RNA ligase 2 (NEB): 1 U/μL, T4 RNA ligase 2 buffer (NEB): 1×, and RNase inhibitor Murine (NEB): 1 U/μL. Substrate and reagents except for PEG 8000, T4 RNA ligase 2, and RNase inhibitor were added to a tube, the resultant was heated at 90° C. for 3 minutes, and the heat was naturally released to room temperature. The rest of the reagents and enzyme was added thereto, followed by incubation at 45° C. for 1 hour. DNase (recombinant, RNase-free, Takara) was added thereto to a final concentration of 0.33 U/μL, followed by incubation at 37° C. for 15 minutes. The resultant was roughly purified by phenol chloroform extraction and isopropanol precipitation to obtain a ligated RNA. The thus obtained reaction sample was analyzed by dPAGE (5% acrylamide, 7 M urea). Gel purification was performed as follows: After performing electrophoresis with dPAGE (6% acrylamide, 7.5 M urea, 25% formamide), a corresponding band was cut out, and subjected to extraction with MQ water for 12 hours. Through a treatment with Amicon 10K (Merck Millipore Corp.) and isopropanol precipitation, a gel extraction product was obtained.

(Translation Reaction of mRNA Sample)

Sequence information of the RN, RN' and EN obtained as described above is shown in Table 145. In Table 145, each nucleotide N (upper case) indicates an RNA, each nucleotide N(F) indicates a 2'-F modified RNA, and N(MOE) indicates a 2'-O-methoxyethyl modified RNA.

TABLE 145

| Compound Name | Sequence (5' to 3') | SEQ ID NO: |
|---|---|---|
| RN and RN' | GGGAAAUAAGAGAGAAAAGAAGAGUAAGAAGAAAUAUAAGAGCCACCA UGAACUUUCUGCUGUCUUGGGUGCAUUGGAGCCUUGCCUUGCUGCUCU ACCUCCACCAUGCCAAGUGGUCCCAGGCUGCACCCAUGGCAGAAGGA | 556 |

TABLE 145-continued

| Compound Name | Sequence (5' to 3') | SEQ ID NO: |
|---|---|---|
| | GGAGGGCAGAAUCAUCACGAAGUGGUGAAGUUCAUGGAUGUCUAUCAG<br>CGCAGCUACUGCCAUCCAAUCGAGACCCUGGUGGACAUCUUCCAGGAG<br>UACCCUGAUGAGAUCGAGUACAUCUUCAAGCCAUCCUGUGUGCCCCUG<br>AUGCGAUGCGGGGGCUGCUGCAAUGACGAGGGCCUGGAGUGUGUGCC<br>CACUGAGGAGUCCAACAUCACCAUGCAGAUUAUGCGGAUCAAACCUCA<br>CCAAGGCCAGCACAUAGGAGAGAUGAGCUUCCUACAGCACAACAAAUG<br>UGAAUGCAGACCAAAGAAAGAUAGAGCAAGACAAGAAAAUCCCUGUGG<br>GCCUUGCUCAGAGCGGAGAAAGCAUUUGUUUGUACAAGAUCCGCAGAC<br>GUGUAAAUGUUCCUGCAAAAACACAGACUCGCGUUGCAAGGCGAGGCA<br>GCUUGAGUUAAACGAACGUACUUGCAGAUGUGACAAGCCGAGGCGGUG<br>AUAAUAGGCUGGAGCCUCGGUGGCCAUGCUUCUUGCCCCUUGGGCCU<br>CCCCCCAGCCCCUCCUCCCCUUCCUGCACCCGUACCCCCGUGGUCUU<br>UGAAUAAAGUCUGAGUGGGCGGCAAAAAAAAAAAAAAAAAAAAAAAAAAA<br>AAAAAAAAAAAAAAAAAAAAAAAAAAAAAAAAAAAAAAAAAAAAAAAAAAA<br>AAAAAAAAAAAAAAAAAAAAAAAAAAAUCUAG | |
| EN | G(MOE)G(MOE)G(MOE)A(MOE)A(MOE)A(MOE)UAA(F)GAG(F)<br>AGA(F)AAA(F)GAA(F)GAG(F)UAA(F)GAA(F)GAA(F)AUA(F)<br>UAA(F)GAG(F)CCA(F)CCA(F)UGA(F)ACU(F)UUC(F)UGC(F)<br>UGU(F)CUUGGGUGCAUUGGAGCCUUGCCUUGCUGCUCUACCUCCACC<br>AUGCCAAGUGGUCCCAGGCUGCACCCAUGGCAGAAGGAGGAGGGCAGA<br>AUCAUCACGAAGUGGUGAAGUUCAUGGAUGUCUAUCAGCGCAGCUACU<br>GCCAUCCAAUCGAGACCCUGGUGGACAUCUUCCAGGAGUACCCUGAUG<br>AGAUCGAGUACAUCUUCAAGCCAUCCUGUGUGCCCCUGAUGCGAUGCG<br>GGGGCUGCUGCAAUGACGAGGGCCUGGAGUGUGUGCCCACUGAGGAGU<br>CCAACAUCACCAUGCAGAUUAUGCGGAUCAAACCUCACCAAGGCCAGC<br>ACAUAGGAGAGAUGAGCUUCCUACAGCACAACAAAUGUGAAUGCAGAC<br>CAAAGAAAGAUAGAGCAAGACAAGAAAAUCCCUGUGGGCCUUGCUCAG<br>AGCGGAGAAAGCAUUUGUUUGUACAAGAUCCGCAGACGUGUAAAUGUU<br>CCUGCAAAAACACAGACUCGCGUUGCAAGGCGAGGCAGCUUGAGUUAA<br>ACGAACGUACUUGCAGAUGUGACAAGCCGAGGCGGUGAUAAUAGGCUG<br>GAGCCUCGGUGGCCAUGCUUCUUGCCCCUUGGGCCUCCCCCCAGCCCC<br>UCCUCCCCUUCCUGCACCCGUACCCCCGUGGUCUUUGAAUAAAGUCUG<br>AGUGGGCGGCAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAA<br>AAAAAAAAAAAAAAAUCUAG | 557 |

The RN, RN', and EN were evaluated for translation activity in vitro with Hela cell line. First, a Hela cell suspended in RPMI medium (manufactured by Nacalai Tesque, Inc.) containing 10% fetal bovine serum was seeded in a 96 well adherent cell culture plate at 10,000 cells/100 μL per well, and the resultant was cultured at 37° C. under 5% CO2 condition overnight. A culture supernatant was removed from the cell cultured overnight, RPMI medium containing 40 μL of 10% fetal bovine serum per well was added thereto, and each compound and Lipofectamin Messenger MAX Transfection Reagent (manufactured by Thermo Fisher Scientific K.K., Catalog No: LMRNA008) at a final concentration of 0.3% were diluted and mixed with Opti-MEM (manufactured by Thermo Fisher Scientific K.K., Catalog No: 31985-070) to a final concentration of 0.3, 1, 3 or 10 nM of each compound, the resultant mixture was added to each culture plate in an amount of 10 μL per well, and the resultant was cultured at 37° C. under 5% CO2 condition for 4 hours. A culture supernatant was recovered from the cell cultured for 4 hours, and RPMI medium containing 10% fetal bovine serum was added thereto in an amount of 50 μL per well, and the resultant was further cultured at 37° C. under 5% CO2 condition overnight. A culture supernatant was recovered from the cell cultured for 24 hours.

An amount of VEGF protein in the thus obtained culture supernatant was measured with Human VEGE Quantikine ELISA (manufactured by R & D, Catalog No. DVE00) in accordance with a manual attached to the kit. As results of the measurement, a VEGF protein concentration (ng/mL) in each culture supernatant quantitatively determined is shown in the following table:

TABLE 146

Concentration of Translation Product obtained from Compound

| Compound Name | Time of Collecting Supernatant | Translation Product Concentration (nM) Nucleic Acid 0.3 nM | Nucleic Acid 1 nM | Nucleic Acid 3 nM | Nucleic Acid 10 nM |
|---|---|---|---|---|---|
| RN | 4 hr | 0.21 | 0.26 | 1.20 | 1.73 |
| RN' | 4 hr | 0.24 | 0.39 | 1.38 | 1.93 |
| EN | 4 hr | 0.34 | 0.79 | 5.50 | 6.68 |
| RN | 24 hr | 2.67 | 3.29 | 8.46 | 10.64 |
| RN' | 24 hr | 3.05 | 3.91 | 9.23 | 11.12 |
| EN | 24 hr | 3.94 | 10.51 | 54.81 | 62.74 |

As is obvious from the evaluation results described above, the EN having sugar modification produced, after being added to the Hela cell, VEGF protein encoded by a gene sequence, and the efficiency was more excellent than that of RN and RN' having no sugar modification.

Sequence Listing Free Test

SEQ ID NO: 1: compound E1
SEQ ID NO: 2: compound E1-1
SEQ ID NO: 3: compound E1-2
SEQ ID NO: 4: template DNA 1
SEQ ID NO: 5: compound E2
SEQ ID NO: 6: compound E2-1
SEQ ID NO: 7: compound E2-2
SEQ ID NO: 8: compound E3

SEQ ID NO: 9: compound E3-1
SEQ ID NO: 10: compound E3-2
SEQ ID NO: 11: compound E4
SEQ ID NO: 12: compound E4-1
SEQ ID NO: 13: compound E4-2
SEQ ID NO: 14: compound R1
SEQ ID NO: 15: compound R1-1
SEQ ID NO: 16: compound R1-2
SEQ ID NO: 17: template DNA2
SEQ ID NO: 18: compound R2
SEQ ID NO: 19: compound R2-1
SEQ ID NO: 20: compound R2-2
SEQ ID NO: 21: compound R3
SEQ ID NO: 22: compound R3-1
SEQ ID NO: 23: compound R3-2
SEQ ID NO: 24: template DNA3
SEQ ID NO: 25: compound R4
SEQ ID NO: 26: compound R4-1
SEQ ID NO: 27: compound R4-2
SEQ ID NO: 28: compound R4-3
SEQ ID NO: 29: template DNA4
SEQ ID NO: 30: compound R5
SEQ ID NO: 31: compound R5-1
SEQ ID NO: 32: compound R5-2
SEQ ID NO: 33: compound R6
SEQ ID NO: 34: compound R6-1
SEQ ID NO: 35: compound R6-2
SEQ ID NO: 36: compound R7
SEQ ID NO: 37: compound R7-1
SEQ ID NO: 38: compound R7-2
SEQ ID NO: 39: compound R8
SEQ ID NO: 40: compound R8-1
SEQ ID NO: 41: compound R8-2
SEQ ID NO: 42: compound R9
SEQ ID NO: 43: compound R9-1
SEQ ID NO: 44: compound R9-2
SEQ ID NO: 45: compound R10
SEQ ID NO: 46: compound R10-1
SEQ ID NO: 47: compound R10-2
SEQ ID NO: 48: compound R11
SEQ ID NO: 49: compound R11-1
SEQ ID NO: 50: compound R11-2
SEQ ID NO: 51: compound R12
SEQ ID NO: 52: compound R12-1
SEQ ID NO: 53: compound R12-2
SEQ ID NO: 54: compound R13
SEQ ID NO: 55: compound R13-1
SEQ ID NO: 56: compound R13-2
SEQ ID NO: 57: compound R14
SEQ ID NO: 58: compound R14-1
SEQ ID NO: 59: compound R14-2
SEQ ID NO: 60: compound R15
SEQ ID NO: 61: compound R15-1
SEQ ID NO: 62: compound R15-2
SEQ ID NO: 63: compound R16
SEQ ID NO: 64: compound R16-1
SEQ ID NO: 65: compound R16-2
SEQ ID NO: 66: compound R17
SEQ ID NO: 67: compound R17-1
SEQ ID NO: 68: compound R17-2
SEQ ID NO: 69: compound R17-3
SEQ ID NO: 70: template DNA5
SEQ ID NO: 71: template DNA6
SEQ ID NO: 72: compound R18
SEQ ID NO: 73: compound R18-1
SEQ ID NO: 74: compound R18-2
SEQ ID NO: 75: RT primer
SEQ ID NO: 76: Fw primer
SEQ ID NO: 77: Rv primer
SEQ ID NO: 78: Taqman MGB Probe
SEQ ID NOS: 79 to 538: compounds E5 to E248-1
SEQ ID NOS: 539 to 542: translation product polypeptide preparation
SEQ ID NO: 543: FW primer
SEQ ID NO: 544: RV primer 1
SEQ ID NO: 545: 5' end polynucleotide sequence RN-1
SEQ ID NO: 546: artificially synthesized gene sequence GN
SEQ ID NO: 547: template DNA-A
SEQ ID NO: 548: RV primer 2
SEQ ID NO: 549: sequence primer M13FW
SEQ ID NO: 550: sequence primer M13RV
SEQ ID NO: 551: 5' end polynucleotide sequence RN'-1
SEQ ID NO: 552: artificially synthesized gene sequence GN'
SEQ ID NO: 553: template DNA-B
SEQ ID NO: 554: EN-1
SEQ ID NO: 555: template DNA-C
SEQ ID NO: 556: compounds RN and RN'
SEQ ID NO: 557: compound EN

SEQUENCE LISTING (557 sequences)

SEQ ID NO: 1 - RNA, 145 nt, Artificial Sequence
  E1
  modified_base (2)..(2): 2'-deoxy-2'-fluoroguanosine
  modified_base (5)..(5): 2'-deoxy-2'-fluoroguanosine
  modified_base (8)..(8): 2'-deoxy-2'-fluorouridine
  modified_base (11)..(11): 2'-deoxy-2'-fluoroadenosine
  modified_base (14)..(14): 2'-deoxy-2'-fluorocytidine
  modified_base (17)..(17): 2'-deoxy-2'-fluorocytidine
  modified_base (20)..(20): 2'-deoxy-2'-fluoroguanosine
  modified_base (23)..(23): 2'-deoxy-2'-fluorocytidine
  modified_base (26)..(26): 2'-deoxy-2'-fluorouridine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorouridine
gggagaauacaagcuacuuguucuuuuugcagccaccauggacuacaaggacgacgacgacaagaucaucgacuauaaagacgacgacgauaaagguggcgacuauaaggacgacgacgacaaacaccaccaccaccaccacuga

SEQ ID NO: 2 - RNA, 80 nt, Artificial Sequence
  E1-1
  modified_base (2)..(2): 2'-deoxy-2'-fluoroguanosine
  modified_base (5)..(5): 2'-deoxy-2'-fluoroguanosine
  modified_base (8)..(8): 2'-deoxy-2'-fluorouridine
  modified_base (11)..(11): 2'-deoxy-2'-fluoroadenosine
  modified_base (14)..(14): 2'-deoxy-2'-fluorocytidine
  modified_base (17)..(17): 2'-deoxy-2'-fluorocytidine
  modified_base (20)..(20): 2'-deoxy-2'-fluoroguanosine
  modified_base (23)..(23): 2'-deoxy-2'-fluorocytidine
  modified_base (26)..(26): 2'-deoxy-2'-fluorouridine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
gggagaauacaagcuacuuguucuuuuugcagccaccauggacuacaaggacgacgacgacaagaucaucgacuauaaag

SEQ ID NO: 3 - RNA, 65 nt, Artificial Sequence
  E1-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine
acgacgacgauaaagguggcgacuauaaggacgacgacgacaaacaccaccaccaccaccacuga

SEQ ID NO: 4 - DNA, 30 bp, Artificial Sequence
  Template DNA 1
cctttatcgtcgtcgtctttatagtcgatg

SEQ ID NO: 5 - RNA, 165 nt, Artificial Sequence
  E2
  modified_base (2)..(2): 2'-deoxy-2'-fluoroguanosine
  modified_base (5)..(5): 2'-deoxy-2'-fluoroguanosine
  modified_base (8)..(8): 2'-deoxy-2'-fluorouridine
  modified_base (11)..(11): 2'-deoxy-2'-fluoroadenosine
  modified_base (14)..(14): 2'-deoxy-2'-fluorocytidine
  modified_base (17)..(17): 2'-deoxy-2'-fluorocytidine
  modified_base (20)..(20): 2'-deoxy-2'-fluoroguanosine
  modified_base (23)..(23): 2'-deoxy-2'-fluorocytidine
  modified_base (26)..(26): 2'-deoxy-2'-fluorouridine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorouridine
  modified_base (146)..(146): 2'-deoxy-2'-fluoroadenosine
  modified_base (149)..(149): 2'-deoxy-2'-fluoroadenosine
  modified_base (152)..(152): 2'-deoxy-2'-fluoroadenosine
  modified_base (155)..(155): 2'-deoxy-2'-fluoroadenosine
  modified_base (158)..(158): 2'-deoxy-2'-fluoroadenosine
  modified_base (161)..(161): 2'-deoxy-2'-fluoroadenosine
  modified_base (164)..(164): 2'-deoxy-2'-fluoroadenosine
gggagaauacaagcuacuuguucuuuuugcagccaccauggacuacaaggacgacgacgacaagaucaucgacuauaaagacgacgacgauaaagguggcgacuauaaggacgacgacgacaaacaccaccaccaccaccacugaaaaaaaaaaaaaaaaaaaaa

SEQ ID NO: 6 - RNA, 80 nt, Artificial Sequence; identical to SEQ ID NO: 2
  E2-1
  modified_base (2)..(2): 2'-deoxy-2'-fluoroguanosine
  modified_base (5)..(5): 2'-deoxy-2'-fluoroguanosine
  modified_base (8)..(8): 2'-deoxy-2'-fluorouridine
  modified_base (11)..(11): 2'-deoxy-2'-fluoroadenosine
  modified_base (14)..(14): 2'-deoxy-2'-fluorocytidine
  modified_base (17)..(17): 2'-deoxy-2'-fluorocytidine
  modified_base (20)..(20): 2'-deoxy-2'-fluoroguanosine
  modified_base (23)..(23): 2'-deoxy-2'-fluorocytidine
  modified_base (26)..(26): 2'-deoxy-2'-fluorouridine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 7 - RNA, 85 nt, Artificial Sequence
  E2-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine
  modified_base (66)..(66): 2'-deoxy-2'-fluoroadenosine
  modified_base (69)..(69): 2'-deoxy-2'-fluoroadenosine
  modified_base (72)..(72): 2'-deoxy-2'-fluoroadenosine
  modified_base (75)..(75): 2'-deoxy-2'-fluoroadenosine
  modified_base (78)..(78): 2'-deoxy-2'-fluoroadenosine
  modified_base (81)..(81): 2'-deoxy-2'-fluoroadenosine
  modified_base (84)..(84): 2'-deoxy-2'-fluoroadenosine
acgacgacgauaaagguggcgacuauaaggacgacgacgacaaacaccaccaccaccaccacugaaaaaaaaaaaaaaaaaaaaa

SEQ ID NO: 8 - RNA, 165 nt, Artificial Sequence; identical to SEQ ID NO: 5
  E3
  modified_base (2)..(2): 2'-deoxy-2'-fluoroguanosine
  modified_base (5)..(5): 2'-deoxy-2'-fluoroguanosine
  modified_base (8)..(8): 2'-deoxy-2'-fluorouridine
  modified_base (11)..(11): 2'-deoxy-2'-fluoroadenosine
  modified_base (14)..(14): 2'-deoxy-2'-fluorocytidine
  modified_base (17)..(17): 2'-deoxy-2'-fluorocytidine
  modified_base (20)..(20): 2'-deoxy-2'-fluoroguanosine
  modified_base (23)..(23): 2'-deoxy-2'-fluorocytidine
  modified_base (26)..(26): 2'-deoxy-2'-fluorouridine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorouridine

SEQ ID NO: 9 - RNA, 80 nt, Artificial Sequence; identical to SEQ ID NO: 2
  E3-1
  modified_base (2)..(2): 2'-deoxy-2'-fluoroguanosine
  modified_base (5)..(5): 2'-deoxy-2'-fluoroguanosine
  modified_base (8)..(8): 2'-deoxy-2'-fluorouridine
  modified_base (11)..(11): 2'-deoxy-2'-fluoroadenosine
  modified_base (14)..(14): 2'-deoxy-2'-fluorocytidine
  modified_base (17)..(17): 2'-deoxy-2'-fluorocytidine
  modified_base (20)..(20): 2'-deoxy-2'-fluoroguanosine
  modified_base (23)..(23): 2'-deoxy-2'-fluorocytidine
  modified_base (26)..(26): 2'-deoxy-2'-fluorouridine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 10 - RNA, 85 nt, Artificial Sequence; identical to SEQ ID NO: 7
  E3-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine

SEQ ID NO: 11 - RNA, 145 nt, Artificial Sequence; identical to SEQ ID NO: 1
  E4
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 12 - RNA, 80 nt, Artificial Sequence; identical to SEQ ID NO: 2
  E4-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 13 - RNA, 65 nt, Artificial Sequence; identical to SEQ ID NO: 3
  E4-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 14 - RNA, 126 nt, Artificial Sequence
  R1
  misc_feature (70)..(71): phosphoryl amide bond
auuauuaaggagauauauccgaugauuauugacuacaaggacgacgaugacaaaauuauugacuacaaggacgacgaugacaaacugcugauuauugacuacaaggacgacgaugacaaaauuauu

SEQ ID NO: 15 - RNA, 70 nt, Artificial Sequence
  R1-1
  misc_feature (70)..(70): 3'-hydroxyl group is substituted by amino group
auuauuaaggagauauauccgaugauuauugacuacaaggacgacgaugacaaaauuauugacuacaagg

SEQ ID NO: 16 - RNA, 56 nt, Artificial Sequence
  R1-2
  misc_feature (1)..(1): 5'-phosphorylated
acgacgaugacaaacugcugauuauugacuacaaggacgacgaugacaaaauuauu

SEQ ID NO: 17 - DNA, 40 bp, Artificial Sequence
  Template DNA 2
cagcagtttgtcatcgtcgtccttgtagtcaataattttg

SEQ ID NO: 18 - RNA, 145 nt, Artificial Sequence; identical to SEQ ID NO: 1
  R2
  misc_feature (80)..(81): phosphoryl amide bond

SEQ ID NO: 19 - RNA, 80 nt, Artificial Sequence; identical to SEQ ID NO: 2
  R2-1
  misc_feature (80)..(80): 3'-hydroxyl group is substituted by amino group

SEQ ID NO: 20 - RNA, 65 nt, Artificial Sequence; identical to SEQ ID NO: 3
  R2-2
  misc_feature (1)..(1): 5'-phosphorylated

SEQ ID NO: 21 - RNA, 145 nt, Artificial Sequence; identical to SEQ ID NO: 1
  R3
  misc_feature (49)..(50): phosphoryl amide bond

SEQ ID NO: 22 - RNA, 49 nt, Artificial Sequence
  R3-1
  misc_feature (49)..(49): 3'-hydroxyl group is substituted by amino group
gggagaauacaagcuacuuguucuuuuugcagccaccauggacuacaag

SEQ ID NO: 23 - RNA, 96 nt, Artificial Sequence
  R3-2
  misc_feature (1)..(1): 5'-phosphorylated
gacgacgacgacaagaucaucgacuauaaagacgacgacgauaaagguggcgacuauaaggacgacgacgacaaacaccaccaccaccaccacuga

SEQ ID NO: 24 - DNA, 24 bp, Artificial Sequence
  Template DNA 3
gtcgtcgtcgtccttgtagtccat

SEQ ID NO: 25 - RNA, 145 nt, Artificial Sequence; identical to SEQ ID NO: 1
  R4
  misc_feature (29)..(30): phosphoryl amide bond
  misc_feature (80)..(81): phosphoryl amide bond

SEQ ID NO: 26 - RNA, 29 nt, Artificial Sequence
  R4-1
  misc_feature (29)..(29): 3'-hydroxyl group is substituted by amino group
gggagaauacaagcuacuuguucuuuuug

SEQ ID NO: 27 - RNA, 51 nt, Artificial Sequence
  R4-2
  misc_feature (1)..(1): 5'-phosphorylated
  misc_feature (51)..(51): 3'-hydroxyl group is substituted by amino group
cagccaccauggacuacaaggacgacgacgacaagaucaucgacuauaaag

SEQ ID NO: 28 - RNA, 65 nt, Artificial Sequence; identical to SEQ ID NO: 3
  R4-3
  misc_feature (1)..(1): 5'-phosphorylated

SEQ ID NO: 29 - DNA, 28 bp, Artificial Sequence
  Template DNA 4
gtccatggtggctgcaaaaagaacaagt

SEQ ID NO: 30 - RNA, 145 nt, Artificial Sequence; identical to SEQ ID NO: 1
  R5
  misc_feature (80)..(81): -NHC(O)-CH2-S-P(O)(OH)-O- bond

SEQ ID NO: 31 - RNA, 80 nt, Artificial Sequence; identical to SEQ ID NO: 2
  R5-1
  misc_feature (80)..(80): 3'-hydroxyl group is substituted by amino group

SEQ ID NO: 32 - RNA, 65 nt, Artificial Sequence; identical to SEQ ID NO: 3
  R5-2
  misc_feature (1)..(1): 5'-phosphorothioated

SEQ ID NO: 33 - RNA, 165 nt, Artificial Sequence; identical to SEQ ID NO: 5
  R6

SEQ ID NO: 34 - RNA, 80 nt, Artificial Sequence; identical to SEQ ID NO: 2
  R6-1

SEQ ID NO: 35 - RNA, 85 nt, Artificial Sequence; identical to SEQ ID NO: 7
  R6-2
  misc_feature (1)..(1): 5'-phosphorylated

SEQ ID NO: 36 - RNA, 145 nt, Artificial Sequence; identical to SEQ ID NO: 1
  R7
  modified_base (1)..(1): 2'-deoxy-2'-fluoroguanosine
  modified_base (2)..(2): 2'-deoxy-2'-fluoroguanosine
  modified_base (3)..(3): 2'-deoxy-2'-fluoroguanosine
  modified_base (4)..(4): 2'-deoxy-2'-fluoroadenosine
  modified_base (5)..(5): 2'-deoxy-2'-fluoroguanosine
  modified_base (6)..(6): 2'-deoxy-2'-fluoroadenosine
  modified_base (7)..(7): 2'-deoxy-2'-fluoroadenosine
  modified_base (8)..(8): 2'-deoxy-2'-fluorouridine
  modified_base (9)..(9): 2'-deoxy-2'-fluoroadenosine
  modified_base (10)..(10): 2'-deoxy-2'-fluorocytidine
  modified_base (11)..(11): 2'-deoxy-2'-fluoroadenosine
  modified_base (12)..(12): 2'-deoxy-2'-fluoroadenosine
  modified_base (13)..(13): 2'-deoxy-2'-fluoroguanosine
  modified_base (14)..(14): 2'-deoxy-2'-fluorocytidine
  modified_base (15)..(15): 2'-deoxy-2'-fluorouridine
  modified_base (16)..(16): 2'-deoxy-2'-fluoroadenosine
  modified_base (17)..(17): 2'-deoxy-2'-fluorocytidine
  modified_base (18)..(18): 2'-deoxy-2'-fluorouridine
  modified_base (19)..(19): 2'-deoxy-2'-fluorouridine
  modified_base (20)..(20): 2'-deoxy-2'-fluoroguanosine
  modified_base (21)..(21): 2'-deoxy-2'-fluorouridine
  modified_base (22)..(22): 2'-deoxy-2'-fluorouridine
  modified_base (23)..(23): 2'-deoxy-2'-fluorocytidine
  modified_base (24)..(24): 2'-deoxy-2'-fluorouridine
  modified_base (25)..(25): 2'-deoxy-2'-fluorouridine
  modified_base (26)..(26): 2'-deoxy-2'-fluorouridine
  modified_base (27)..(27): 2'-deoxy-2'-fluorouridine
  modified_base (28)..(28): 2'-deoxy-2'-fluorouridine
  modified_base (29)..(29): 2'-deoxy-2'-fluoroguanosine
  modified_base (30)..(30): 2'-deoxy-2'-fluorocytidine
  modified_base (31)..(31): 2'-deoxy-2'-fluoroadenosine

SEQ ID NO: 37 - RNA, 80 nt, Artificial Sequence; identical to SEQ ID NO: 2
  R7-1
  modified_base (1)..(1): 2'-deoxy-2'-fluoroguanosine
  modified_base (2)..(2): 2'-deoxy-2'-fluoroguanosine
  modified_base (3)..(3): 2'-deoxy-2'-fluoroguanosine
  modified_base (4)..(4): 2'-deoxy-2'-fluoroadenosine
  modified_base (5)..(5): 2'-deoxy-2'-fluoroguanosine
  modified_base (6)..(6): 2'-deoxy-2'-fluoroadenosine
  modified_base (7)..(7): 2'-deoxy-2'-fluoroadenosine
  modified_base (8)..(8): 2'-deoxy-2'-fluorouridine
  modified_base (9)..(9): 2'-deoxy-2'-fluoroadenosine
  modified_base (10)..(10): 2'-deoxy-2'-fluorocytidine
  modified_base (11)..(11): 2'-deoxy-2'-fluoroadenosine
  modified_base (12)..(12): 2'-deoxy-2'-fluoroadenosine
  modified_base (13)..(13): 2'-deoxy-2'-fluoroguanosine
  modified_base (14)..(14): 2'-deoxy-2'-fluorocytidine
  modified_base (15)..(15): 2'-deoxy-2'-fluorouridine
  modified_base (16)..(16): 2'-deoxy-2'-fluoroadenosine
  modified_base (17)..(17): 2'-deoxy-2'-fluorocytidine
  modified_base (18)..(18): 2'-deoxy-2'-fluorouridine
  modified_base (19)..(19): 2'-deoxy-2'-fluorouridine
  modified_base (20)..(20): 2'-deoxy-2'-fluoroguanosine
  modified_base (21)..(21): 2'-deoxy-2'-fluorouridine
  modified_base (22)..(22): 2'-deoxy-2'-fluorouridine
  modified_base (23)..(23): 2'-deoxy-2'-fluorocytidine
  modified_base (24)..(24): 2'-deoxy-2'-fluorouridine
  modified_base (25)..(25): 2'-deoxy-2'-fluorouridine
  modified_base (26)..(26): 2'-deoxy-2'-fluorouridine
  modified_base (27)..(27): 2'-deoxy-2'-fluorouridine
  modified_base (28)..(28): 2'-deoxy-2'-fluorouridine
  modified_base (29)..(29): 2'-deoxy-2'-fluoroguanosine
  modified_base (30)..(30): 2'-deoxy-2'-fluorocytidine
  modified_base (31)..(31): 2'-deoxy-2'-fluoroadenosine

SEQ ID NO: 38 - RNA, 65 nt, Artificial Sequence; identical to SEQ ID NO: 3
  R7-2
  misc_feature (1)..(1): 5'-phosphorylated

SEQ ID NO: 39 - RNA, 145 nt, Artificial Sequence; identical to SEQ ID NO: 1
  R8
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (7)..(7): 2'-O-methyladenosine
  modified_base (8)..(8): 2'-O-methyluridine
  modified_base (9)..(9): 2'-O-methyladenosine
  modified_base (10)..(10): 2'-O-methylcytidine
  modified_base (11)..(11): 2'-O-methyladenosine
  modified_base (12)..(12): 2'-O-methyladenosine
  modified_base (13)..(13): 2'-O-methylguanosine
  modified_base (14)..(14): 2'-O-methylcytidine
  modified_base (15)..(15): 2'-O-methyluridine
  modified_base (16)..(16): 2'-O-methyladenosine
  modified_base (17)..(17): 2'-O-methylcytidine
  modified_base (18)..(18): 2'-O-methyluridine
  modified_base (19)..(19): 2'-O-methyluridine
  modified_base (20)..(20): 2'-O-methylguanosine
  modified_base (21)..(21): 2'-O-methyluridine
  modified_base (22)..(22): 2'-O-methyluridine
  modified_base (23)..(23): 2'-O-methylcytidine
  modified_base (24)..(24): 2'-O-methyluridine
  modified_base (25)..(25): 2'-O-methyluridine
  modified_base (26)..(26): 2'-O-methyluridine
  modified_base (27)..(27): 2'-O-methyluridine
  modified_base (28)..(28): 2'-O-methyluridine
  modified_base (29)..(29): 2'-O-methylguanosine
  modified_base (30)..(30): 2'-O-methylcytidine
  modified_base (31)..(31): 2'-O-methyladenosine

SEQ ID NO: 40 - RNA, 80 nt, Artificial Sequence; identical to SEQ ID NO: 2
  R8-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (7)..(7): 2'-O-methyladenosine
  modified_base (8)..(8): 2'-O-methyluridine
  modified_base (9)..(9): 2'-O-methyladenosine
  modified_base (10)..(10): 2'-O-methylcytidine
  modified_base (11)..(11): 2'-O-methyladenosine
  modified_base (12)..(12): 2'-O-methyladenosine
  modified_base (13)..(13): 2'-O-methylguanosine
  modified_base (14)..(14): 2'-O-methylcytidine
  modified_base (15)..(15): 2'-O-methyluridine
  modified_base (16)..(16): 2'-O-methyladenosine
  modified_base (17)..(17): 2'-O-methylcytidine
  modified_base (18)..(18): 2'-O-methyluridine
  modified_base (19)..(19): 2'-O-methyluridine
  modified_base (20)..(20): 2'-O-methylguanosine
  modified_base (21)..(21): 2'-O-methyluridine
  modified_base (22)..(22): 2'-O-methyluridine
  modified_base (23)..(23): 2'-O-methylcytidine
  modified_base (24)..(24): 2'-O-methyluridine
  modified_base (25)..(25): 2'-O-methyluridine
  modified_base (26)..(26): 2'-O-methyluridine
  modified_base (27)..(27): 2'-O-methyluridine
  modified_base (28)..(28): 2'-O-methyluridine
  modified_base (29)..(29): 2'-O-methylguanosine
  modified_base (30)..(30): 2'-O-methylcytidine
  modified_base (31)..(31): 2'-O-methyladenosine

SEQ ID NO: 41 - RNA, 65 nt, Artificial Sequence; identical to SEQ ID NO: 3
  R8-2
  misc_feature (1)..(1): 5'-phosphorylated

SEQ ID NO: 42 - RNA, 145 nt, Artificial Sequence; identical to SEQ ID NO: 1
  R9
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine
  modified_base (7)..(7): 2'-deoxy-2'-fluoroadenosine
  modified_base (8)..(8): 2'-O-methyluridine
  modified_base (9)..(9): 2'-deoxy-2'-fluoroadenosine
  modified_base (10)..(10): 2'-O-methylcytidine
  modified_base (11)..(11): 2'-deoxy-2'-fluoroadenosine
  modified_base (12)..(12): 2'-O-methyladenosine
  modified_base (13)..(13): 2'-deoxy-2'-fluoroguanosine
  modified_base (14)..(14): 2'-O-methylcytidine
  modified_base (15)..(15): 2'-deoxy-2'-fluorouridine
  modified_base (16)..(16): 2'-O-methyladenosine
  modified_base (17)..(17): 2'-deoxy-2'-fluorocytidine
  modified_base (18)..(18): 2'-O-methyluridine
  modified_base (19)..(19): 2'-deoxy-2'-fluorouridine
  modified_base (20)..(20): 2'-O-methylguanosine
  modified_base (21)..(21): 2'-deoxy-2'-fluorouridine
  modified_base (22)..(22): 2'-O-methyluridine
  modified_base (23)..(23): 2'-deoxy-2'-fluorocytidine
  modified_base (24)..(24): 2'-O-methyluridine
  modified_base (25)..(25): 2'-deoxy-2'-fluorouridine
  modified_base (26)..(26): 2'-O-methyluridine
  modified_base (27)..(27): 2'-deoxy-2'-fluorouridine
  modified_base (28)..(28): 2'-O-methyluridine
  modified_base (29)..(29): 2'-deoxy-2'-fluoroguanosine
  modified_base (30)..(30): 2'-O-methylcytidine
  modified_base (31)..(31): 2'-deoxy-2'-fluoroadenosine

SEQ ID NO: 43 - RNA, 80 nt, Artificial Sequence; identical to SEQ ID NO: 2
  R9-1
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine
  modified_base (7)..(7): 2'-deoxy-2'-fluoroadenosine
  modified_base (8)..(8): 2'-O-methyluridine
  modified_base (9)..(9): 2'-deoxy-2'-fluoroadenosine
  modified_base (10)..(10): 2'-O-methylcytidine
  modified_base (11)..(11): 2'-deoxy-2'-fluoroadenosine
  modified_base (12)..(12): 2'-O-methyladenosine
  modified_base (13)..(13): 2'-deoxy-2'-fluoroguanosine
  modified_base (14)..(14): 2'-O-methylcytidine
  modified_base (15)..(15): 2'-deoxy-2'-fluorouridine
  modified_base (16)..(16): 2'-O-methyladenosine
  modified_base (17)..(17): 2'-deoxy-2'-fluorocytidine
  modified_base (18)..(18): 2'-O-methyluridine
  modified_base (19)..(19): 2'-deoxy-2'-fluorouridine
  modified_base (20)..(20): 2'-O-methylguanosine
  modified_base (21)..(21): 2'-deoxy-2'-fluorouridine
  modified_base (22)..(22): 2'-O-methyluridine
  modified_base (23)..(23): 2'-deoxy-2'-fluorocytidine
  modified_base (24)..(24): 2'-O-methyluridine
  modified_base (25)..(25): 2'-deoxy-2'-fluorouridine
  modified_base (26)..(26): 2'-O-methyluridine
  modified_base (27)..(27): 2'-deoxy-2'-fluorouridine
  modified_base (28)..(28): 2'-O-methyluridine
  modified_base (29)..(29): 2'-deoxy-2'-fluoroguanosine
  modified_base (30)..(30): 2'-O-methylcytidine
  modified_base (31)..(31): 2'-deoxy-2'-fluoroadenosine

SEQ ID NO: 44 - RNA, 65 nt, Artificial Sequence; identical to SEQ ID NO: 3
  R9-2
  misc_feature (1)..(1): 5'-phosphorylated

SEQ ID NO: 45 - RNA, 145 nt, Artificial Sequence; identical to SEQ ID NO: 1
  R10
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (7)..(7): 2'-O-methyladenosine
  modified_base (8)..(8): 2'-O-methyluridine
  modified_base (9)..(9): 2'-O-methyladenosine
  modified_base (10)..(10): 2'-O-methylcytidine
  modified_base (11)..(11): 2'-O-methyladenosine
  modified_base (12)..(12): 2'-O-methyladenosine
  modified_base (13)..(13): 2'-O-methylguanosine
  modified_base (14)..(14): 2'-O-methylcytidine
  modified_base (15)..(15): 2'-O-methyluridine
  modified_base (16)..(16): 2'-O-methyladenosine
  modified_base (17)..(17): 2'-O-methylcytidine
  modified_base (18)..(18): 2'-O-methyluridine
  modified_base (19)..(19): 2'-O-methyluridine
  modified_base (20)..(20): 2'-O-methylguanosine
  modified_base (21)..(21): 2'-O-methyluridine
  modified_base (22)..(22): 2'-O-methyluridine
  modified_base (23)..(23): 2'-O-methylcytidine
  modified_base (24)..(24): 2'-O-methyluridine
  modified_base (25)..(25): 2'-O-methyluridine
  modified_base (26)..(26): 2'-O-methyluridine
  modified_base (27)..(27): 2'-O-methyluridine
  modified_base (28)..(28): 2'-O-methyluridine
  modified_base (29)..(29): 2'-O-methylguanosine
  modified_base (30)..(30): 2'-O-methylcytidine
  modified_base (31)..(31): 2'-O-methyladenosine
  modified_base (32)..(32): 2'-O-methylguanosine
  modified_base (33)..(33): 2'-O-methylcytidine
  modified_base (34)..(34): 2'-O-methylcytidine
  modified_base (35)..(35): 2'-O-methyladenosine
  modified_base (36)..(36): 2'-O-methylcytidine
  modified_base (37)..(37): 2'-O-methylcytidine
  modified_base (38)..(38): 2'-O-methyladenosine
  modified_base (39)..(39): 2'-O-methyluridine
  modified_base (40)..(40): 2'-O-methylguanosine
  modified_base (41)..(41): 2'-O-methylguanosine
  modified_base (42)..(42): 2'-O-methyladenosine
  modified_base (43)..(43): 2'-O-methylcytidine
  modified_base (44)..(44): 2'-O-methyluridine
  modified_base (45)..(45): 2'-O-methyladenosine
  modified_base (46)..(46): 2'-O-methylcytidine
  modified_base (47)..(47): 2'-O-methyladenosine
  modified_base (48)..(48): 2'-O-methyladenosine
  modified_base (49)..(49): 2'-O-methylguanosine
  modified_base (50)..(50): 2'-O-methylguanosine
  modified_base (51)..(51): 2'-O-methyladenosine
  modified_base (52)..(52): 2'-O-methylcytidine
  modified_base (53)..(53): 2'-O-methylguanosine
  modified_base (54)..(54): 2'-O-methyladenosine
  modified_base (55)..(55): 2'-O-methylcytidine
  modified_base (56)..(56): 2'-O-methylguanosine
  modified_base (57)..(57): 2'-O-methyladenosine
  modified_base (58)..(58): 2'-O-methylcytidine
  modified_base (59)..(59): 2'-O-methylguanosine
  modified_base (60)..(60): 2'-O-methyladenosine
  modified_base (61)..(61): 2'-O-methylcytidine
  modified_base (62)..(62): 2'-O-methyladenosine
  modified_base (63)..(63): 2'-O-methyladenosine
  modified_base (64)..(64): 2'-O-methylguanosine
  modified_base (65)..(65): 2'-O-methyladenosine
  modified_base (66)..(66): 2'-O-methyluridine
  modified_base (67)..(67): 2'-O-methylcytidine
  modified_base (68)..(68): 2'-O-methyladenosine
  modified_base (69)..(69): 2'-O-methyluridine
  modified_base (70)..(70): 2'-O-methylcytidine
  modified_base (71)..(71): 2'-O-methylguanosine
  modified_base (72)..(72): 2'-O-methyladenosine
  modified_base (73)..(73): 2'-O-methylcytidine
  modified_base (74)..(74): 2'-O-methyluridine
  modified_base (75)..(75): 2'-O-methyladenosine
  modified_base (76)..(76): 2'-O-methyluridine
  modified_base (77)..(77): 2'-O-methyladenosine
  modified_base (78)..(78): 2'-O-methyladenosine
  modified_base (79)..(79): 2'-O-methyladenosine
  modified_base (84)..(84): 2'-O-methyladenosine
  modified_base (85)..(85): 2'-O-methylcytidine
  modified_base (86)..(86): 2'-O-methylguanosine
  modified_base (87)..(87): 2'-O-methyladenosine
  modified_base (88)..(88): 2'-O-methylcytidine
  modified_base (89)..(89): 2'-O-methylguanosine
  modified_base (90)..(90): 2'-O-methyladenosine
  modified_base (91)..(91): 2'-O-methyluridine
  modified_base (92)..(92): 2'-O-methyladenosine
  modified_base (93)..(93): 2'-O-methyladenosine
  modified_base (94)..(94): 2'-O-methyladenosine
  modified_base (95)..(95): 2'-O-methylguanosine
  modified_base (96)..(96): 2'-O-methylguanosine
  modified_base (97)..(97): 2'-O-methyluridine
  modified_base (98)..(98): 2'-O-methylguanosine
  modified_base (99)..(99): 2'-O-methylguanosine
  modified_base (100)..(100): 2'-O-methylcytidine
  modified_base (101)..(101): 2'-O-methylguanosine
  modified_base (102)..(102): 2'-O-methyladenosine
  modified_base (103)..(103): 2'-O-methylcytidine
  modified_base (104)..(104): 2'-O-methyluridine
  modified_base (105)..(105): 2'-O-methyladenosine
  modified_base (106)..(106): 2'-O-methyluridine
  modified_base (107)..(107): 2'-O-methyladenosine
  modified_base (108)..(108): 2'-O-methyladenosine
  modified_base (109)..(109): 2'-O-methylguanosine
  modified_base (110)..(110): 2'-O-methylguanosine
  modified_base (111)..(111): 2'-O-methyladenosine
  modified_base (112)..(112): 2'-O-methylcytidine
  modified_base (113)..(113): 2'-O-methylguanosine
  modified_base (114)..(114): 2'-O-methyladenosine
  modified_base (115)..(115): 2'-O-methylcytidine
  modified_base (116)..(116): 2'-O-methylguanosine
  modified_base (117)..(117): 2'-O-methyladenosine
  modified_base (118)..(118): 2'-O-methylcytidine
  modified_base (119)..(119): 2'-O-methylguanosine
  modified_base (120)..(120): 2'-O-methyladenosine
  modified_base (121)..(121): 2'-O-methylcytidine
  modified_base (122)..(122): 2'-O-methyladenosine
  modified_base (123)..(123): 2'-O-methyladenosine
  modified_base (124)..(124): 2'-O-methyladenosine
  modified_base (125)..(125): 2'-O-methylcytidine
  modified_base (126)..(126): 2'-O-methyladenosine
  modified_base (127)..(127): 2'-O-methylcytidine
  modified_base (128)..(128): 2'-O-methylcytidine
  modified_base (129)..(129): 2'-O-methyladenosine
  modified_base (130)..(130): 2'-O-methylcytidine
  modified_base (131)..(131): 2'-O-methylcytidine
  modified_base (132)..(132): 2'-O-methyladenosine
  modified_base (133)..(133): 2'-O-methylcytidine
  modified_base (134)..(134): 2'-O-methylcytidine
  modified_base (135)..(135): 2'-O-methyladenosine
  modified_base (136)..(136): 2'-O-methylcytidine
  modified_base (137)..(137): 2'-O-methylcytidine
  modified_base (138)..(138): 2'-O-methyladenosine
  modified_base (139)..(139): 2'-O-methylcytidine
  modified_base (140)..(140): 2'-O-methylcytidine
  modified_base (141)..(141): 2'-O-methyladenosine
  modified_base (142)..(142): 2'-O-methylcytidine
  modified_base (143)..(143): 2'-O-methyluridine
  modified_base (144)..(144): 2'-O-methylguanosine
  modified_base (145)..(145): 2'-O-methyladenosine

SEQ ID NO: 46 - RNA, 80 nt, Artificial Sequence; identical to SEQ ID NO: 2
  R10-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (7)..(7): 2'-O-methyladenosine
  modified_base (8)..(8): 2'-O-methyluridine
  modified_base (9)..(9): 2'-O-methyladenosine
  modified_base (10)..(10): 2'-O-methylcytidine
  modified_base (11)..(11): 2'-O-methyladenosine
  modified_base (12)..(12): 2'-O-methyladenosine
  modified_base (13)..(13): 2'-O-methylguanosine
  modified_base (14)..(14): 2'-O-methylcytidine
  modified_base (15)..(15): 2'-O-methyluridine
  modified_base (16)..(16): 2'-O-methyladenosine
  modified_base (17)..(17): 2'-O-methylcytidine
  modified_base (18)..(18): 2'-O-methyluridine
  modified_base (19)..(19): 2'-O-methyluridine
  modified_base (20)..(20): 2'-O-methylguanosine
  modified_base (21)..(21): 2'-O-methyluridine
  modified_base (22)..(22): 2'-O-methyluridine
  modified_base (23)..(23): 2'-O-methylcytidine
  modified_base (24)..(24): 2'-O-methyluridine
  modified_base (25)..(25): 2'-O-methyluridine
  modified_base (26)..(26): 2'-O-methyluridine
  modified_base (27)..(27): 2'-O-methyluridine
  modified_base (28)..(28): 2'-O-methyluridine
  modified_base (29)..(29): 2'-O-methylguanosine
  modified_base (30)..(30): 2'-O-methylcytidine
  modified_base (31)..(31): 2'-O-methyladenosine
  modified_base (32)..(32): 2'-O-methylguanosine
  modified_base (33)..(33): 2'-O-methylcytidine
  modified_base (34)..(34): 2'-O-methylcytidine
  modified_base (35)..(35): 2'-O-methyladenosine
  modified_base (36)..(36): 2'-O-methylcytidine
  modified_base (37)..(37): 2'-O-methylcytidine
  modified_base (38)..(38): 2'-O-methyladenosine
  modified_base (39)..(39): 2'-O-methyluridine
  modified_base (40)..(40): 2'-O-methylguanosine
  modified_base (41)..(41): 2'-O-methylguanosine
  modified_base (42)..(42): 2'-O-methyladenosine
  modified_base (43)..(43): 2'-O-methylcytidine
  modified_base (44)..(44): 2'-O-methyluridine
  modified_base (45)..(45): 2'-O-methyladenosine
  modified_base (46)..(46): 2'-O-methylcytidine
  modified_base (47)..(47): 2'-O-methyladenosine
  modified_base (48)..(48): 2'-O-methyladenosine
  modified_base (49)..(49): 2'-O-methylguanosine
  modified_base (50)..(50): 2'-O-methylguanosine
  modified_base (51)..(51): 2'-O-methyladenosine
  modified_base (52)..(52): 2'-O-methylcytidine
  modified_base (53)..(53): 2'-O-methylguanosine
  modified_base (54)..(54): 2'-O-methyladenosine
  modified_base (55)..(55): 2'-O-methylcytidine
  modified_base (56)..(56): 2'-O-methylguanosine
  modified_base (57)..(57): 2'-O-methyladenosine
  modified_base (58)..(58): 2'-O-methylcytidine
  modified_base (59)..(59): 2'-O-methylguanosine
  modified_base (60)..(60): 2'-O-methyladenosine
  modified_base (61)..(61): 2'-O-methylcytidine
  modified_base (62)..(62): 2'-O-methyladenosine
  modified_base (63)..(63): 2'-O-methyladenosine
  modified_base (64)..(64): 2'-O-methylguanosine
  modified_base (65)..(65): 2'-O-methyladenosine
  modified_base (66)..(66): 2'-O-methyluridine
  modified_base (67)..(67): 2'-O-methylcytidine
  modified_base (68)..(68): 2'-O-methyladenosine
  modified_base (69)..(69): 2'-O-methyluridine
  modified_base (70)..(70): 2'-O-methylcytidine
  modified_base (71)..(71): 2'-O-methylguanosine
  modified_base (72)..(72): 2'-O-methyladenosine
  modified_base (73)..(73): 2'-O-methylcytidine
  modified_base (74)..(74): 2'-O-methyluridine
  modified_base (75)..(75): 2'-O-methyladenosine
  modified_base (76)..(76): 2'-O-methyluridine
  modified_base (77)..(77): 2'-O-methyladenosine
  modified_base (78)..(78): 2'-O-methyladenosine
  modified_base (79)..(79): 2'-O-methyladenosine

SEQ ID NO: 47 - RNA, 65 nt, Artificial Sequence; identical to SEQ ID NO: 3
  R10-2
  misc_feature (1)..(1): 5'-phosphorylated
  modified_base (4)..(4): 2'-O-methyladenosine
  modified_base (5)..(5): 2'-O-methylcytidine
  modified_base (6)..(6): 2'-O-methylguanosine
  modified_base (7)..(7): 2'-O-methyladenosine
  modified_base (8)..(8): 2'-O-methylcytidine
  modified_base (9)..(9): 2'-O-methylguanosine
  modified_base (10)..(10): 2'-O-methyladenosine
  modified_base (11)..(11): 2'-O-methyluridine
  modified_base (12)..(12): 2'-O-methyladenosine
  modified_base (13)..(13): 2'-O-methyladenosine
  modified_base (14)..(14): 2'-O-methyladenosine
  modified_base (15)..(15): 2'-O-methylguanosine
  modified_base (16)..(16): 2'-O-methylguanosine
  modified_base (17)..(17): 2'-O-methyluridine
  modified_base (18)..(18): 2'-O-methylguanosine
  modified_base (19)..(19): 2'-O-methylguanosine
  modified_base (20)..(20): 2'-O-methylcytidine
  modified_base (21)..(21): 2'-O-methylguanosine
  modified_base (22)..(22): 2'-O-methyladenosine
  modified_base (23)..(23): 2'-O-methylcytidine
  modified_base (24)..(24): 2'-O-methyluridine
  modified_base (25)..(25): 2'-O-methyladenosine
  modified_base (26)..(26): 2'-O-methyluridine
  modified_base (27)..(27): 2'-O-methyladenosine
  modified_base (28)..(28): 2'-O-methyladenosine
  modified_base (29)..(29): 2'-O-methylguanosine
  modified_base (30)..(30): 2'-O-methylguanosine
  modified_base (31)..(31): 2'-O-methyladenosine
  modified_base (32)..(32): 2'-O-methylcytidine
  modified_base (33)..(33): 2'-O-methylguanosine
  modified_base (34)..(34): 2'-O-methyladenosine
  modified_base (35)..(35): 2'-O-methylcytidine
  modified_base (36)..(36): 2'-O-methylguanosine
  modified_base (37)..(37): 2'-O-methyladenosine
  modified_base (38)..(38): 2'-O-methylcytidine
  modified_base (39)..(39): 2'-O-methylguanosine
  modified_base (40)..(40): 2'-O-methyladenosine
  modified_base (41)..(41): 2'-O-methylcytidine
  modified_base (42)..(42): 2'-O-methyladenosine
  modified_base (43)..(43): 2'-O-methyladenosine
  modified_base (44)..(44): 2'-O-methyladenosine
  modified_base (45)..(45): 2'-O-methylcytidine
  modified_base (46)..(46): 2'-O-methyladenosine
  modified_base (47)..(47): 2'-O-methylcytidine
  modified_base (48)..(48): 2'-O-methylcytidine
  modified_base (49)..(49): 2'-O-methyladenosine
  modified_base (50)..(50): 2'-O-methylcytidine
  modified_base (51)..(51): 2'-O-methylcytidine
  modified_base (52)..(52): 2'-O-methyladenosine
  modified_base (53)..(53): 2'-O-methylcytidine
  modified_base (54)..(54): 2'-O-methylcytidine
  modified_base (55)..(55): 2'-O-methyladenosine
  modified_base (56)..(56): 2'-O-methylcytidine
  modified_base (57)..(57): 2'-O-methylcytidine
  modified_base (58)..(58): 2'-O-methyladenosine
  modified_base (59)..(59): 2'-O-methylcytidine
  modified_base (60)..(60): 2'-O-methylcytidine
  modified_base (61)..(61): 2'-O-methyladenosine
  modified_base (62)..(62): 2'-O-methylcytidine
  modified_base (63)..(63): 2'-O-methyluridine
  modified_base (64)..(64): 2'-O-methylguanosine
  modified_base (65)..(65): 2'-O-methyladenosine

SEQ ID NO: 48 - RNA, 145 nt, Artificial Sequence; identical to SEQ ID NO: 1
  R11
  modified_base (80)..(80): 2'-deoxy-2'-fluoroguanosine
  misc_feature (80)..(81): phosphoryl amide bond

SEQ ID NO: 49 - RNA, 80 nt, Artificial Sequence; identical to SEQ ID NO: 2
  R11-1
  modified_base (80)..(80): 2'-deoxy-2'-fluoroguanosine
  misc_feature (80)..(80): 3'-phosphorylated

SEQ ID NO: 50 - RNA, 65 nt, Artificial Sequence; identical to SEQ ID NO: 3
  R11-2
  misc_feature (1)..(1): 5'-hydroxyl group is substituted by amino group

SEQ ID NO: 51 - RNA, 145 nt, Artificial Sequence; identical to SEQ ID NO: 1
  R12
  modified_base (1)..(1): 2'-O-methylguanosine
  modified_base (2)..(2): 2'-O-methylguanosine
  modified_base (3)..(3): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 52 - RNA, 80 nt, Artificial Sequence; identical to SEQ ID NO: 2
  R12-1
  modified_base (1)..(1): 2'-O-methylguanosine
  modified_base (2)..(2): 2'-O-methylguanosine
  modified_base (3)..(3): 2'-O-methylguanosine

SEQ ID NO: 53 - RNA, 65 nt, Artificial Sequence; identical to SEQ ID NO: 3
  R12-2
  misc_feature (1)..(1): 5'-phosphorylated
  modified_base (63)..(63): 2'-O-methyluridine
  modified_base (64)..(64): 2'-O-methylguanosine
  modified_base (65)..(65): 2'-O-methyladenosine

SEQ ID NO: 54 - RNA, 145 nt, Artificial Sequence; identical to SEQ ID NO: 1
  R13
  modified_base (1)..(1): 2'-deoxy-2'-fluoroguanosine
  modified_base (2)..(2): 2'-deoxy-2'-fluoroguanosine
  modified_base (3)..(3): 2'-deoxy-2'-fluoroguanosine
  modified_base (143)..(143): 2'-deoxy-2'-fluorouridine
  modified_base (144)..(144): 2'-deoxy-2'-fluoroguanosine
  modified_base (145)..(145): 2'-deoxy-2'-fluoroadenosine

SEQ ID NO: 55 - RNA, 80 nt, Artificial Sequence; identical to SEQ ID NO: 2
  R13-1
  modified_base (1)..(1): 2'-deoxy-2'-fluoroguanosine
  modified_base (2)..(2): 2'-deoxy-2'-fluoroguanosine
  modified_base (3)..(3): 2'-deoxy-2'-fluoroguanosine

SEQ ID NO: 56 - RNA, 65 nt, Artificial Sequence; identical to SEQ ID NO: 3
  R13-2
  misc_feature (1)..(1): 5'-phosphorylated
  modified_base (63)..(63): 2'-deoxy-2'-fluorouridine
  modified_base (64)..(64): 2'-deoxy-2'-fluoroguanosine
  modified_base (65)..(65): 2'-deoxy-2'-fluoroadenosine

SEQ ID NO: 57 - RNA, 145 nt, Artificial Sequence; identical to SEQ ID NO: 1
  R14
  misc_feature (1)..(1): LNA
  misc_feature (2)..(2): LNA
  misc_feature (3)..(3): LNA
  misc_feature (143)..(143): LNA
  misc_feature (144)..(144): LNA
  misc_feature (145)..(145): LNA

SEQ ID NO: 58 - RNA, 80 nt, Artificial Sequence; identical to SEQ ID NO: 2
  R14-1
  misc_feature (1)..(1): LNA
  misc_feature (2)..(2): LNA
  misc_feature (3)..(3): LNA

SEQ ID NO: 59 - RNA, 65 nt, Artificial Sequence; identical to SEQ ID NO: 3
  R14-2
  misc_feature (1)..(1): 5'-phosphorylated
  misc_feature (63)..(63): LNA
  misc_feature (64)..(64): LNA
  misc_feature (65)..(65): LNA

SEQ ID NO: 60 - RNA, 145 nt, Artificial Sequence; identical to SEQ ID NO: 1
  R15
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (143)..(143): 2'-O-methoxyethyluridine
  modified_base (144)..(144): 2'-O-methoxyethylguanosine
  modified_base (145)..(145): 2'-O-methoxyethyladenosine

SEQ ID NO: 61 - RNA, 80 nt, Artificial Sequence; identical to SEQ ID NO: 2
  R15-1
  modified_base (1)..(1): 2'-O-methoxyethylguanosine
  modified_base (2)..(2): 2'-O-methoxyethylguanosine
  modified_base (3)..(3): 2'-O-methoxyethylguanosine

SEQ ID NO: 62 - RNA, 65 nt, Artificial Sequence; identical to SEQ ID NO: 3
  R15-2
  misc_feature (1)..(1): 5'-phosphorylated
  modified_base (63)..(63): 2'-O-methoxyethyluridine
  modified_base (64)..(64): 2'-O-methoxyethylguanosine
  modified_base (65)..(65): 2'-O-methoxyethyladenosine

SEQ ID NO: 63 - RNA, 145 nt, Artificial Sequence; identical to SEQ ID NO: 1
  R16
  modified_base (4)..(4): 6-methyladenosine
  modified_base (6)..(6): 6-methyladenosine
  modified_base (7)..(7): 6-methyladenosine
  modified_base (9)..(9): 6-methyladenosine
  modified_base (11)..(11): 6-methyladenosine
  modified_base (12)..(12): 6-methyladenosine
  modified_base (16)..(16): 6-methyladenosine
  modified_base (31)..(31): 6-methyladenosine
  modified_base (35)..(35): 6-methyladenosine
  modified_base (38)..(38): 6-methyladenosine

SEQ ID NO: 64 - RNA, 80 nt, Artificial Sequence; identical to SEQ ID NO: 2
  R16-1
  modified_base (4)..(4): 6-methyladenosine
  modified_base (6)..(6): 6-methyladenosine
  modified_base (7)..(7): 6-methyladenosine
  modified_base (9)..(9): 6-methyladenosine
  modified_base (11)..(11): 6-methyladenosine
  modified_base (12)..(12): 6-methyladenosine
  modified_base (16)..(16): 6-methyladenosine
  modified_base (31)..(31): 6-methyladenosine
  modified_base (35)..(35): 6-methyladenosine
  modified_base (38)..(38): 6-methyladenosine

SEQ ID NO: 65 - RNA, 65 nt, Artificial Sequence; identical to SEQ ID NO: 3
  R16-2
  misc_feature (1)..(1): 5'-phosphorylated

SEQ ID NO: 66 - RNA, 126 nt, Artificial Sequence; identical to SEQ ID NO: 14
  R17

SEQ ID NO: 67 - RNA, 40 nt, Artificial Sequence
  R17-1
auuauuaaggagauauauccgaugauuauugacuacaagg

SEQ ID NO: 68 - RNA, 44 nt, Artificial Sequence
  R17-2
  misc_feature (1)..(1): 5'-phosphorylated
acgacgaugacaaaauuauugacuacaaggacgacgaugacaaa

SEQ ID NO: 69 - RNA, 42 nt, Artificial Sequence
  R17-3
  misc_feature (1)..(1): 5'-phosphorylated
cugcugauuauugacuacaaggacgacgaugacaaaauuauu

SEQ ID NO: 70 - DNA, 21 bp, Artificial Sequence
  Template DNA 5
gtcatcgtcgtccttgtagtc

SEQ ID NO: 71 - DNA, 23 bp, Artificial Sequence
  Template DNA 6
caataatcagcagtttgtcatcg

SEQ ID NO: 72 - RNA, 145 nt, Artificial Sequence; identical to SEQ ID NO: 1
  R18

SEQ ID NO: 73 - RNA, 80 nt, Artificial Sequence; identical to SEQ ID NO: 2
  R18-1

SEQ ID NO: 74 - RNA, 65 nt, Artificial Sequence; identical to SEQ ID NO: 3
  R18-2
  misc_feature (1)..(1): 5'-phosphorylated

SEQ ID NO: 75 - DNA, 25 bp, Artificial Sequence
  RT primer
tcagtggtggtggtggtggtgtttg

SEQ ID NO: 76 - DNA, 20 bp, Artificial Sequence
  forward primer
atcttgtcgtcgtcgtcctt

SEQ ID NO: 77 - DNA, 23 bp, Artificial Sequence
  reverse primer
gaatacaagctacttgttctttt

SEQ ID NO: 78 - DNA, 11 bp, Artificial Sequence
  TaqMan MGB probe
cagccaccatg

SEQ ID NO: 79 - RNA, 264 nt, Artificial Sequence
  E5
gggagccaccauggacuacaaggacgacgacgacaagaucaucgacuauaaagacgacgacgauaaagguggcgacuauaaggacgacgacgacaaagccauuaauagugacucugaguguccccugucccacgacggguacugccuccacgacggugugugcauguauauugaagcauuggacaaguacgccugcaacuguguuguuggcuacaucggggagcgcugucaguaccgagaccugaaguggugggaacugcgccu

SEQ ID NO: 80 - RNA, 94 nt, Artificial Sequence
  E5-1
gggagccaccauggacuacaaggacgacgacgacaagaucaucgacuauaaagacgacgacgauaaagguggcgacuauaaggacgacgacgac

SEQ ID NO: 81 - RNA, 85 nt, Artificial Sequence
  E5-2
  misc_feature (1)..(1): 5'-phosphorylated
aaagccauuaauagugacucugaguguccccugucccacgacggguacugccuccacgacggugugugcauguauauugaagcau

SEQ ID NO: 82 - RNA, 85 nt, Artificial Sequence
  E5-3
  misc_feature (1)..(1): 5'-phosphorylated
uggacaaguacgccugcaacuguguuguuggcuacaucggggagcgcugucaguaccgagaccugaaguggugggaacugcgccu

SEQ ID NO: 83 - RNA, 169 nt, Artificial Sequence
  E6
gggagaauacaagcuacuuguucuuuuugcagccaccauggacuacaaggacgacgacgacaagaucaucgacuauaaagacgacgacgauaaagguggcgacuauaaggacgacgacgacaaaaguauaauaaacuuugaaaaacugcaccaccaccaccaccacuga

SEQ ID NO: 84 - RNA, 89 nt, Artificial Sequence
  E6-1
gggagaauacaagcuacuuguucuuuuugcagccaccauggacuacaaggacgacgacgacaagaucaucgacuauaaagacgacgacg

SEQ ID NO: 85 - RNA, 80 nt, Artificial Sequence
  E6-2
  misc_feature (1)..(1): 5'-phosphorylated
auaaagguggcgacuauaaggacgacgacgacaaaaguauaauaaacuuugaaaaacugcaccaccaccaccaccacuga

SEQ ID NO: 86 - RNA, 145 nt, Artificial Sequence; identical to SEQ ID NO: 1
  E7
  modified_base (2)..(2): 2'-deoxy-2'-fluoroguanosine
  modified_base (5)..(5): 2'-deoxy-2'-fluoroguanosine
  modified_base (8)..(8): 2'-deoxy-2'-fluorouridine
  modified_base (11)..(11): 2'-deoxy-2'-fluoroadenosine
  modified_base (14)..(14): 2'-deoxy-2'-fluorocytidine
  modified_base (17)..(17): 2'-deoxy-2'-fluorocytidine
  modified_base (20)..(20): 2'-deoxy-2'-fluoroguanosine
  modified_base (23)..(23): 2'-deoxy-2'-fluorocytidine
  modified_base (26)..(26): 2'-deoxy-2'-fluorouridine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorouridine

SEQ ID NO: 87 - RNA, 80 nt, Artificial Sequence; identical to SEQ ID NO: 2
  E7-1
  modified_base (2)..(2): 2'-deoxy-2'-fluoroguanosine
  modified_base (5)..(5): 2'-deoxy-2'-fluoroguanosine
  modified_base (8)..(8): 2'-deoxy-2'-fluorouridine
  modified_base (11)..(11): 2'-deoxy-2'-fluoroadenosine
  modified_base (14)..(14): 2'-deoxy-2'-fluorocytidine
  modified_base (17)..(17): 2'-deoxy-2'-fluorocytidine
  modified_base (20)..(20): 2'-deoxy-2'-fluoroguanosine
  modified_base (23)..(23): 2'-deoxy-2'-fluorocytidine
  modified_base (26)..(26): 2'-deoxy-2'-fluorouridine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 88 - RNA, 65 nt, Artificial Sequence; identical to SEQ ID NO: 3
  E7-2
  misc_feature (1)..(1): 5'-phosphorylated
  modified_base (3)..(3): 2'-deoxy-2'-fluoroguanosine
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine

SEQ ID NO: 89 - RNA, 145 nt, Artificial Sequence; identical to SEQ ID NO: 1
  E8
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorouridine

SEQ ID NO: 90 - RNA, 80 nt, Artificial Sequence; identical to SEQ ID NO: 2
  E8-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 91 - RNA, 65 nt, Artificial Sequence; identical to SEQ ID NO: 3
  E8-2
  misc_feature (1)..(1): 5'-phosphorylated
  modified_base (3)..(3): 2'-deoxy-2'-fluoroguanosine
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine

SEQ ID NO: 92 - RNA, 145 nt, Artificial Sequence; identical to SEQ ID NO: 1
  E9
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (125)..(125): 2'-O-methylcytidine
  modified_base (128)..(128): 2'-O-methylcytidine
  modified_base (131)..(131): 2'-O-methylcytidine
  modified_base (134)..(134): 2'-O-methylcytidine
  modified_base (137)..(137): 2'-O-methylcytidine
  modified_base (140)..(140): 2'-O-methylcytidine
  modified_base (143)..(143): 2'-O-methyluridine
  modified_base (144)..(144): 2'-O-methylguanosine
  modified_base (145)..(145): 2'-O-methyladenosine

SEQ ID NO: 93 - RNA, 80 nt, Artificial Sequence; identical to SEQ ID NO: 2
  E9-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 94 - RNA, 65 nt, Artificial Sequence; identical to SEQ ID NO: 3
  E9-2
  misc_feature (1)..(1): 5'-phosphorylated
  modified_base (45)..(45): 2'-O-methylcytidine
  modified_base (48)..(48): 2'-O-methylcytidine
  modified_base (51)..(51): 2'-O-methylcytidine
  modified_base (54)..(54): 2'-O-methylcytidine
  modified_base (57)..(57): 2'-O-methylcytidine
  modified_base (60)..(60): 2'-O-methylcytidine
  modified_base (63)..(63): 2'-O-methyluridine
  modified_base (64)..(64): 2'-O-methylguanosine
  modified_base (65)..(65): 2'-O-methyladenosine

SEQ ID NO: 95 - RNA, 145 nt, Artificial Sequence; identical to SEQ ID NO: 1
  E10
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (77)..(77): 2'-O-methyladenosine
  modified_base (92)..(92): 2'-O-methyladenosine
  modified_base (122)..(122): 2'-O-methyladenosine
  modified_base (143)..(143): 2'-O-methyluridine
  modified_base (144)..(144): 2'-O-methylguanosine
  modified_base (145)..(145): 2'-O-methyladenosine

SEQ ID NO: 96 - RNA, 80 nt, Artificial Sequence; identical to SEQ ID NO: 2
  E10-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (77)..(77): 2'-O-methyladenosine

SEQ ID NO: 97 - RNA, 65 nt, Artificial Sequence; identical to SEQ ID NO: 3
  E10-2
  misc_feature (1)..(1): 5'-phosphorylated
  modified_base (12)..(12): 2'-O-methyladenosine
  modified_base (42)..(42): 2'-O-methyladenosine
  modified_base (63)..(63): 2'-O-methyluridine
  modified_base (64)..(64): 2'-O-methylguanosine
  modified_base (65)..(65): 2'-O-methyladenosine

SEQ ID NO: 98 - RNA, 145 nt, Artificial Sequence; identical to SEQ ID NO: 1
  E11
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (49)..(49): 2'-O-methylguanosine
  modified_base (64)..(64): 2'-O-methylguanosine
  modified_base (109)..(109): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 99 - RNA, 80 nt, Artificial Sequence; identical to SEQ ID NO: 2
  E11-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (49)..(49): 2'-O-methylguanosine
  modified_base (64)..(64): 2'-O-methylguanosine

SEQ ID NO: 100 - RNA, 65 nt, Artificial Sequence; identical to SEQ ID NO: 3
  E11-2
  misc_feature (1)..(1): 5'-phosphorylated
  modified_base (29)..(29): 2'-O-methylguanosine
  modified_base (63)..(63): 2'-O-methyluridine
  modified_base (64)..(64): 2'-O-methylguanosine
  modified_base (65)..(65): 2'-O-methyladenosine

SEQ ID NO: 101 - RNA, 145 nt, Artificial Sequence; identical to SEQ ID NO: 1
  E12
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (76)..(76): 2'-O-methyluridine
  modified_base (91)..(91): 2'-O-methyluridine
  modified_base (97)..(97): 2'-O-methyluridine
  modified_base (106)..(106): 2'-O-methyluridine
  modified_base (143)..(143): 2'-O-methyluridine
  modified_base (144)..(144): 2'-O-methylguanosine
  modified_base (145)..(145): 2'-O-methyladenosine

SEQ ID NO: 102 - RNA, 80 nt, Artificial Sequence; identical to SEQ ID NO: 2
  E12-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (76)..(76): 2'-O-methyluridine

SEQ ID NO: 103 - RNA, 65 nt, Artificial Sequence; identical to SEQ ID NO: 3
  E12-2
  misc_feature (1)..(1): 5'-phosphorylated
  modified_base (11)..(11): 2'-O-methyluridine
  modified_base (17)..(17): 2'-O-methyluridine
  modified_base (26)..(26): 2'-O-methyluridine
  modified_base (63)..(63): 2'-O-methyluridine
  modified_base (64)..(64): 2'-O-methylguanosine
  modified_base (65)..(65): 2'-O-methyladenosine

SEQ ID NO: 104 - RNA, 145 nt, Artificial Sequence; identical to SEQ ID NO: 1
  E13
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (43)..(43): 2'-O-methylcytidine
  modified_base (52)..(52): 2'-O-methylcytidine
  modified_base (55)..(55): 2'-O-methylcytidine
  modified_base (58)..(58): 2'-O-methylcytidine
  modified_base (61)..(61): 2'-O-methylcytidine
  modified_base (73)..(73): 2'-O-methylcytidine
  modified_base (85)..(85): 2'-O-methylcytidine
  modified_base (88)..(88): 2'-O-methylcytidine
  modified_base (103)..(103): 2'-O-methylcytidine
  modified_base (112)..(112): 2'-O-methylcytidine
  modified_base (115)..(115): 2'-O-methylcytidine
  modified_base (118)..(118): 2'-O-methylcytidine
  modified_base (121)..(121): 2'-O-methylcytidine
  modified_base (143)..(143): 2'-O-methyluridine
  modified_base (144)..(144): 2'-O-methylguanosine
  modified_base (145)..(145): 2'-O-methyladenosine

SEQ ID NO: 105 - RNA, 80 nt, Artificial Sequence; identical to SEQ ID NO: 2
  E13-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (43)..(43): 2'-O-methylcytidine
  modified_base (52)..(52): 2'-O-methylcytidine
  modified_base (55)..(55): 2'-O-methylcytidine
  modified_base (58)..(58): 2'-O-methylcytidine
  modified_base (61)..(61): 2'-O-methylcytidine
  modified_base (73)..(73): 2'-O-methylcytidine

SEQ ID NO: 106 - RNA, 65 nt, Artificial Sequence; identical to SEQ ID NO: 3
  E13-2
  misc_feature (1)..(1): 5'-phosphorylated
  modified_base (5)..(5): 2'-O-methylcytidine
  modified_base (8)..(8): 2'-O-methylcytidine
  modified_base (23)..(23): 2'-O-methylcytidine
  modified_base (32)..(32): 2'-O-methylcytidine
  modified_base (35)..(35): 2'-O-methylcytidine
  modified_base (38)..(38): 2'-O-methylcytidine
  modified_base (41)..(41): 2'-O-methylcytidine
  modified_base (63)..(63): 2'-O-methyluridine
  modified_base (64)..(64): 2'-O-methylguanosine
  modified_base (65)..(65): 2'-O-methyladenosine

SEQ ID NO: 107 - RNA, 145 nt, Artificial Sequence; identical to SEQ ID NO: 1
  E14
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (91)..(91): 2'-O-methyluridine
  modified_base (143)..(143): 2'-O-methyluridine
  modified_base (144)..(144): 2'-O-methylguanosine
  modified_base (145)..(145): 2'-O-methyladenosine

SEQ ID NO: 108 - RNA, 80 nt, Artificial Sequence; identical to SEQ ID NO: 2
  E14-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 109 - RNA, 65 nt, Artificial Sequence; identical to SEQ ID NO: 3
  E14-2
  misc_feature (1)..(1): 5'-phosphorylated
  modified_base (11)..(11): 2'-O-methyluridine
  modified_base (63)..(63): 2'-O-methyluridine
  modified_base (64)..(64): 2'-O-methylguanosine
  modified_base (65)..(65): 2'-O-methyladenosine

SEQ ID NO: 110 - RNA, 145 nt, Artificial Sequence; identical to SEQ ID NO: 1
  E15
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (71)..(71): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (143)..(143): 2'-O-methyluridine
  modified_base (144)..(144): 2'-O-methylguanosine
  modified_base (145)..(145): 2'-O-methyladenosine

SEQ ID NO: 111 - RNA, 80 nt, Artificial Sequence; identical to SEQ ID NO: 2
  E15-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (71)..(71): 2'-deoxy-2'-fluoroguanosine

SEQ ID NO: 112 - RNA, 65 nt, Artificial Sequence; identical to SEQ ID NO: 3
  E15-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (63)..(63): 2'-O-methyluridine
  modified_base (64)..(64): 2'-O-methylguanosine
  modified_base (65)..(65): 2'-O-methyladenosine

SEQ ID NO: 113 - RNA, 145 nt, Artificial Sequence; identical to SEQ ID NO: 1
  E16
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 114 - RNA, 80 nt, Artificial Sequence; identical to SEQ ID NO: 2
  E16-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 115 - RNA, 65 nt, Artificial Sequence; identical to SEQ ID NO: 3
  E16-2
  misc_feature (1)..(1): 5'-phosphorylated
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 116 - RNA, 145 nt, Artificial Sequence; identical to SEQ ID NO: 1
  E17
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (47)..(47): 2'-deoxy-2'-fluoroadenosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (77)..(77): 2'-deoxy-2'-fluoroadenosine
  modified_base (92)..(92): 2'-deoxy-2'-fluoroadenosine
  modified_base (107)..(107): 2'-deoxy-2'-fluoroadenosine
  modified_base (122)..(122): 2'-deoxy-2'-fluoroadenosine
  modified_base (143)..(143): 2'-O-methyluridine
  modified_base (144)..(144): 2'-O-methylguanosine
  modified_base (145)..(145): 2'-O-methyladenosine

SEQ ID NO: 117 - RNA, 80 nt, Artificial Sequence; identical to SEQ ID NO: 2
  E17-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (47)..(47): 2'-deoxy-2'-fluoroadenosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (77)..(77): 2'-deoxy-2'-fluoroadenosine

SEQ ID NO: 118 - RNA, 65 nt, Artificial Sequence; identical to SEQ ID NO: 3
  E17-2
  misc_feature (1)..(1): 5'-phosphorylated
  modified_base (12)..(12): 2'-deoxy-2'-fluoroadenosine
  modified_base (27)..(27): 2'-deoxy-2'-fluoroadenosine
  modified_base (42)..(42): 2'-deoxy-2'-fluoroadenosine
  modified_base (63)..(63): 2'-O-methyluridine
  modified_base (64)..(64): 2'-O-methylguanosine
  modified_base (65)..(65): 2'-O-methyladenosine

SEQ ID NO: 119 - RNA, 145 nt, Artificial Sequence; identical to SEQ ID NO: 1
  E18
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (44)..(44): 2'-deoxy-2'-fluorouridine
  modified_base (74)..(74): 2'-deoxy-2'-fluorouridine
  modified_base (104)..(104): 2'-deoxy-2'-fluorouridine
  modified_base (143)..(143): 2'-O-methyluridine
  modified_base (144)..(144): 2'-O-methylguanosine
  modified_base (145)..(145): 2'-O-methyladenosine

SEQ ID NO: 120 - RNA, 80 nt, Artificial Sequence; identical to SEQ ID NO: 2
  E18-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (44)..(44): 2'-deoxy-2'-fluorouridine
  modified_base (74)..(74): 2'-deoxy-2'-fluorouridine

SEQ ID NO: 121 - RNA, 65 nt, Artificial Sequence; identical to SEQ ID NO: 3
  E18-2
  misc_feature (1)..(1): 5'-phosphorylated
  modified_base (24)..(24): 2'-deoxy-2'-fluorouridine
  modified_base (63)..(63): 2'-O-methyluridine
  modified_base (64)..(64): 2'-O-methylguanosine
  modified_base (65)..(65): 2'-O-methyladenosine

SEQ ID NO: 122 - RNA, 145 nt, Artificial Sequence; identical to SEQ ID NO: 1
  E19
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (71)..(71): 2'-deoxy-2'-fluoroguanosine
  modified_base (86)..(86): 2'-deoxy-2'-fluoroguanosine
  modified_base (101)..(101): 2'-deoxy-2'-fluoroguanosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (143)..(143): 2'-O-methyluridine
  modified_base (144)..(144): 2'-O-methylguanosine
  modified_base (145)..(145): 2'-O-methyladenosine

SEQ ID NO: 123 - RNA, 80 nt, Artificial Sequence; identical to SEQ ID NO: 2
  E19-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (71)..(71): 2'-deoxy-2'-fluoroguanosine

SEQ ID NO: 124 - RNA, 65 nt, Artificial Sequence; identical to SEQ ID NO: 3
  E19-2
  misc_feature (1)..(1): 5'-phosphorylated
  modified_base (6)..(6): 2'-deoxy-2'-fluoroguanosine
  modified_base (21)..(21): 2'-deoxy-2'-fluoroguanosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (63)..(63): 2'-O-methyluridine
  modified_base (64)..(64): 2'-O-methylguanosine
  modified_base (65)..(65): 2'-O-methyladenosine

SEQ ID NO: 125 - RNA, 145 nt, Artificial Sequence; identical to SEQ ID NO: 1
  E20
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (43)..(43): 2'-deoxy-2'-fluorocytidine
  modified_base (46)..(46): 2'-deoxy-2'-fluorocytidine
  modified_base (49)..(49): 2'-deoxy-2'-fluoroguanosine
  modified_base (52)..(52): 2'-deoxy-2'-fluorocytidine
  modified_base (55)..(55): 2'-deoxy-2'-fluorocytidine
  modified_base (58)..(58): 2'-deoxy-2'-fluorocytidine
  modified_base (61)..(61): 2'-deoxy-2'-fluorocytidine
  modified_base (64)..(64): 2'-deoxy-2'-fluoroguanosine
  modified_base (67)..(67): 2'-deoxy-2'-fluorocytidine
  modified_base (70)..(70): 2'-deoxy-2'-fluorocytidine
  modified_base (73)..(73): 2'-deoxy-2'-fluorocytidine
  modified_base (76)..(76): 2'-deoxy-2'-fluorouridine
  modified_base (79)..(79): 2'-deoxy-2'-fluoroadenosine
  modified_base (85)..(85): 2'-deoxy-2'-fluorocytidine
  modified_base (88)..(88): 2'-deoxy-2'-fluorocytidine
  modified_base (91)..(91): 2'-deoxy-2'-fluorouridine
  modified_base (94)..(94): 2'-deoxy-2'-fluoroadenosine
  modified_base (97)..(97): 2'-deoxy-2'-fluorouridine
  modified_base (100)..(100): 2'-deoxy-2'-fluorocytidine
  modified_base (103)..(103): 2'-deoxy-2'-fluorocytidine
  modified_base (106)..(106): 2'-deoxy-2'-fluorouridine
  modified_base (109)..(109): 2'-deoxy-2'-fluoroguanosine
  modified_base (112)..(112): 2'-deoxy-2'-fluorocytidine
  modified_base (115)..(115): 2'-deoxy-2'-fluorocytidine
  modified_base (118)..(118): 2'-deoxy-2'-fluorocytidine
  modified_base (121)..(121): 2'-deoxy-2'-fluorocytidine
  modified_base (124)..(124): 2'-deoxy-2'-fluoroadenosine
  modified_base (127)..(127): 2'-deoxy-2'-fluorocytidine
  modified_base (130)..(130): 2'-deoxy-2'-fluorocytidine
  modified_base (133)..(133): 2'-deoxy-2'-fluorocytidine
  modified_base (136)..(136): 2'-deoxy-2'-fluorocytidine
  modified_base (139)..(139): 2'-deoxy-2'-fluorocytidine
  modified_base (142)..(142): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 126 - RNA, 80 nt, Artificial Sequence; identical to SEQ ID NO: 2
  E20-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (43)..(43): 2'-deoxy-2'-fluorocytidine
  modified_base (46)..(46): 2'-deoxy-2'-fluorocytidine
  modified_base (49)..(49): 2'-deoxy-2'-fluoroguanosine
  modified_base (52)..(52): 2'-deoxy-2'-fluorocytidine
  modified_base (55)..(55): 2'-deoxy-2'-fluorocytidine
  modified_base (58)..(58): 2'-deoxy-2'-fluorocytidine
  modified_base (61)..(61): 2'-deoxy-2'-fluorocytidine
  modified_base (64)..(64): 2'-deoxy-2'-fluoroguanosine
  modified_base (67)..(67): 2'-deoxy-2'-fluorocytidine
  modified_base (70)..(70): 2'-deoxy-2'-fluorocytidine
  modified_base (73)..(73): 2'-deoxy-2'-fluorocytidine
  modified_base (76)..(76): 2'-deoxy-2'-fluorouridine
  modified_base (79)..(79): 2'-deoxy-2'-fluoroadenosine

SEQ ID NO: 127 - RNA, 65 nt, Artificial Sequence; identical to SEQ ID NO: 3
  E20-2
  misc_feature (1)..(1): 5'-phosphorylated
  modified_base (5)..(5): 2'-deoxy-2'-fluorocytidine
  modified_base (8)..(8): 2'-deoxy-2'-fluorocytidine
  modified_base (11)..(11): 2'-deoxy-2'-fluorouridine
  modified_base (14)..(14): 2'-deoxy-2'-fluoroadenosine
  modified_base (17)..(17): 2'-deoxy-2'-fluorouridine
  modified_base (20)..(20): 2'-deoxy-2'-fluorocytidine
  modified_base (23)..(23): 2'-deoxy-2'-fluorocytidine
  modified_base (26)..(26): 2'-deoxy-2'-fluorouridine
  modified_base (29)..(29): 2'-deoxy-2'-fluoroguanosine
  modified_base (32)..(32): 2'-deoxy-2'-fluorocytidine
  modified_base (35)..(35): 2'-deoxy-2'-fluorocytidine
  modified_base (38)..(38): 2'-deoxy-2'-fluorocytidine
  modified_base (41)..(41): 2'-deoxy-2'-fluorocytidine
  modified_base (44)..(44): 2'-deoxy-2'-fluoroadenosine
  modified_base (47)..(47): 2'-deoxy-2'-fluorocytidine
  modified_base (50)..(50): 2'-deoxy-2'-fluorocytidine
  modified_base (53)..(53): 2'-deoxy-2'-fluorocytidine
  modified_base (56)..(56): 2'-deoxy-2'-fluorocytidine
  modified_base (59)..(59): 2'-deoxy-2'-fluorocytidine
  modified_base (62)..(62): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 128 - RNA, 145 nt, Artificial Sequence; identical to SEQ ID NO: 1
  E21
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (43)..(43): 2'-deoxy-2'-fluorocytidine
  modified_base (44)..(44): 2'-deoxy-2'-fluorouridine
  modified_base (46)..(46): 2'-deoxy-2'-fluorocytidine
  modified_base (47)..(47): 2'-deoxy-2'-fluoroadenosine
  modified_base (49)..(49): 2'-deoxy-2'-fluoroguanosine
  modified_base (50)..(50): 2'-deoxy-2'-fluoroguanosine
  modified_base (52)..(52): 2'-deoxy-2'-fluorocytidine
  modified_base (53)..(53): 2'-deoxy-2'-fluoroguanosine
  modified_base (55)..(55): 2'-deoxy-2'-fluorocytidine
  modified_base (56)..(56): 2'-deoxy-2'-fluoroguanosine
  modified_base (58)..(58): 2'-deoxy-2'-fluorocytidine
  modified_base (59)..(59): 2'-deoxy-2'-fluoroguanosine
  modified_base (61)..(61): 2'-deoxy-2'-fluorocytidine
  modified_base (62)..(62): 2'-deoxy-2'-fluoroadenosine
  modified_base (64)..(64): 2'-deoxy-2'-fluoroguanosine
  modified_base (65)..(65): 2'-deoxy-2'-fluoroadenosine
  modified_base (67)..(67): 2'-deoxy-2'-fluorocytidine
  modified_base (68)..(68): 2'-deoxy-2'-fluoroadenosine
  modified_base (70)..(70): 2'-deoxy-2'-fluorocytidine
  modified_base (71)..(71): 2'-deoxy-2'-fluoroguanosine
  modified_base (73)..(73): 2'-deoxy-2'-fluorocytidine
  modified_base (74)..(74): 2'-deoxy-2'-fluorouridine
  modified_base (76)..(76): 2'-deoxy-2'-fluorouridine
  modified_base (77)..(77): 2'-deoxy-2'-fluoroadenosine
  modified_base (79)..(79): 2'-deoxy-2'-fluoroadenosine
  modified_base (85)..(85): 2'-deoxy-2'-fluorocytidine
  modified_base (86)..(86): 2'-deoxy-2'-fluoroguanosine
  modified_base (88)..(88): 2'-deoxy-2'-fluorocytidine
  modified_base (89)..(89): 2'-deoxy-2'-fluoroguanosine
  modified_base (91)..(91): 2'-deoxy-2'-fluorouridine
  modified_base (92)..(92): 2'-deoxy-2'-fluoroadenosine
  modified_base (94)..(94): 2'-deoxy-2'-fluoroadenosine
  modified_base (95)..(95): 2'-deoxy-2'-fluoroguanosine
  modified_base (97)..(97): 2'-deoxy-2'-fluorouridine
  modified_base (98)..(98): 2'-deoxy-2'-fluoroguanosine
  modified_base (100)..(100): 2'-deoxy-2'-fluorocytidine
  modified_base (101)..(101): 2'-deoxy-2'-fluoroguanosine
  modified_base (103)..(103): 2'-deoxy-2'-fluorocytidine
  modified_base (104)..(104): 2'-deoxy-2'-fluorouridine
  modified_base (106)..(106): 2'-deoxy-2'-fluorouridine
  modified_base (107)..(107): 2'-deoxy-2'-fluoroadenosine
  modified_base (109)..(109): 2'-deoxy-2'-fluoroguanosine
  modified_base (110)..(110): 2'-deoxy-2'-fluoroguanosine
  modified_base (112)..(112): 2'-deoxy-2'-fluorocytidine
  modified_base (113)..(113): 2'-deoxy-2'-fluoroguanosine
  modified_base (115)..(115): 2'-deoxy-2'-fluorocytidine
  modified_base (116)..(116): 2'-deoxy-2'-fluoroguanosine
  modified_base (118)..(118): 2'-deoxy-2'-fluorocytidine
  modified_base (119)..(119): 2'-deoxy-2'-fluoroguanosine
  modified_base (121)..(121): 2'-deoxy-2'-fluorocytidine
  modified_base (122)..(122): 2'-deoxy-2'-fluoroadenosine
  modified_base (124)..(124): 2'-deoxy-2'-fluoroadenosine
  modified_base (125)..(125): 2'-deoxy-2'-fluorocytidine
  modified_base (127)..(127): 2'-deoxy-2'-fluorocytidine
  modified_base (128)..(128): 2'-deoxy-2'-fluorocytidine
  modified_base (130)..(130): 2'-deoxy-2'-fluorocytidine
  modified_base (131)..(131): 2'-deoxy-2'-fluorocytidine
  modified_base (133)..(133): 2'-deoxy-2'-fluorocytidine
  modified_base (134)..(134): 2'-deoxy-2'-fluorocytidine
  modified_base (136)..(136): 2'-deoxy-2'-fluorocytidine
  modified_base (137)..(137): 2'-deoxy-2'-fluorocytidine
  modified_base (139)..(139): 2'-deoxy-2'-fluorocytidine
  modified_base (140)..(140): 2'-deoxy-2'-fluorocytidine
  modified_base (142)..(142): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 129 - RNA, 80 nt, Artificial Sequence; identical to SEQ ID NO: 2
  E21-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (43)..(43): 2'-deoxy-2'-fluorocytidine
  modified_base (44)..(44): 2'-deoxy-2'-fluorouridine
  modified_base (46)..(46): 2'-deoxy-2'-fluorocytidine
  modified_base (47)..(47): 2'-deoxy-2'-fluoroadenosine
  modified_base (49)..(49): 2'-deoxy-2'-fluoroguanosine
  modified_base (50)..(50): 2'-deoxy-2'-fluoroguanosine
  modified_base (52)..(52): 2'-deoxy-2'-fluorocytidine
  modified_base (53)..(53): 2'-deoxy-2'-fluoroguanosine
  modified_base (55)..(55): 2'-deoxy-2'-fluorocytidine
  modified_base (56)..(56): 2'-deoxy-2'-fluoroguanosine
  modified_base (58)..(58): 2'-deoxy-2'-fluorocytidine
  modified_base (59)..(59): 2'-deoxy-2'-fluoroguanosine
  modified_base (61)..(61): 2'-deoxy-2'-fluorocytidine
  modified_base (62)..(62): 2'-deoxy-2'-fluoroadenosine
  modified_base (64)..(64): 2'-deoxy-2'-fluoroguanosine
  modified_base (65)..(65): 2'-deoxy-2'-fluoroadenosine
  modified_base (67)..(67): 2'-deoxy-2'-fluorocytidine
  modified_base (68)..(68): 2'-deoxy-2'-fluoroadenosine
  modified_base (70)..(70): 2'-deoxy-2'-fluorocytidine
  modified_base (71)..(71): 2'-deoxy-2'-fluoroguanosine
  modified_base (73)..(73): 2'-deoxy-2'-fluorocytidine
  modified_base (74)..(74): 2'-deoxy-2'-fluorouridine
  modified_base (76)..(76): 2'-deoxy-2'-fluorouridine
  modified_base (77)..(77): 2'-deoxy-2'-fluoroadenosine
  modified_base (79)..(79): 2'-deoxy-2'-fluoroadenosine

SEQ ID NO: 130 - RNA, 65 nt, Artificial Sequence; identical to SEQ ID NO: 3
  E21-2
  misc_feature (1)..(1): 5'-phosphorylated
  modified_base (5)..(5): 2'-deoxy-2'-fluorocytidine
  modified_base (6)..(6): 2'-deoxy-2'-fluoroguanosine
  modified_base (8)..(8): 2'-deoxy-2'-fluorocytidine
  modified_base (9)..(9): 2'-deoxy-2'-fluoroguanosine
  modified_base (11)..(11): 2'-deoxy-2'-fluorouridine
  modified_base (12)..(12): 2'-deoxy-2'-fluoroadenosine
  modified_base (14)..(14): 2'-deoxy-2'-fluoroadenosine
  modified_base (15)..(15): 2'-deoxy-2'-fluoroguanosine
  modified_base (17)..(17): 2'-deoxy-2'-fluorouridine
  modified_base (18)..(18): 2'-deoxy-2'-fluoroguanosine
  modified_base (20)..(20): 2'-deoxy-2'-fluorocytidine
  modified_base (21)..(21): 2'-deoxy-2'-fluoroguanosine
  modified_base (23)..(23): 2'-deoxy-2'-fluorocytidine
  modified_base (24)..(24): 2'-deoxy-2'-fluorouridine
  modified_base (26)..(26): 2'-deoxy-2'-fluorouridine
  modified_base (27)..(27): 2'-deoxy-2'-fluoroadenosine
  modified_base (29)..(29): 2'-deoxy-2'-fluoroguanosine
  modified_base (30)..(30): 2'-deoxy-2'-fluoroguanosine
  modified_base (32)..(32): 2'-deoxy-2'-fluorocytidine
  modified_base (33)..(33): 2'-deoxy-2'-fluoroguanosine
  modified_base (35)..(35): 2'-deoxy-2'-fluorocytidine
  modified_base (36)..(36): 2'-deoxy-2'-fluoroguanosine
  modified_base (38)..(38): 2'-deoxy-2'-fluorocytidine
  modified_base (39)..(39): 2'-deoxy-2'-fluoroguanosine
  modified_base (41)..(41): 2'-deoxy-2'-fluorocytidine
  modified_base (42)..(42): 2'-deoxy-2'-fluoroadenosine
  modified_base (44)..(44): 2'-deoxy-2'-fluoroadenosine
  modified_base (45)..(45): 2'-deoxy-2'-fluorocytidine
  modified_base (47)..(47): 2'-deoxy-2'-fluorocytidine
  modified_base (48)..(48): 2'-deoxy-2'-fluorocytidine
  modified_base (50)..(50): 2'-deoxy-2'-fluorocytidine
  modified_base (51)..(51): 2'-deoxy-2'-fluorocytidine
  modified_base (53)..(53): 2'-deoxy-2'-fluorocytidine
  modified_base (54)..(54): 2'-deoxy-2'-fluorocytidine
  modified_base (56)..(56): 2'-deoxy-2'-fluorocytidine
  modified_base (57)..(57): 2'-deoxy-2'-fluorocytidine
  modified_base (59)..(59): 2'-deoxy-2'-fluorocytidine
  modified_base (60)..(60): 2'-deoxy-2'-fluorocytidine
  modified_base (62)..(62): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 131 - RNA, 145 nt, Artificial Sequence; identical to SEQ ID NO: 1
  E22
  modified_base (4)..(4): 2'-O-methyladenosine
  modified_base (6)..(6): 2'-O-methyladenosine
  modified_base (7)..(7): 2'-O-methyladenosine
  modified_base (9)..(9): 2'-O-methyladenosine
  modified_base (11)..(11): 2'-O-methyladenosine
  modified_base (12)..(12): 2'-O-methyladenosine
  modified_base (16)..(16): 2'-O-methyladenosine
  modified_base (31)..(31): 2'-O-methyladenosine
  modified_base (35)..(35): 2'-O-methyladenosine

SEQ ID NO: 132 - RNA, 80 nt, Artificial Sequence; identical to SEQ ID NO: 2
  E22-1
  modified_base (4)..(4): 2'-O-methyladenosine
  modified_base (6)..(6): 2'-O-methyladenosine
  modified_base (7)..(7): 2'-O-methyladenosine
  modified_base (9)..(9): 2'-O-methyladenosine
  modified_base (11)..(11): 2'-O-methyladenosine
  modified_base (12)..(12): 2'-O-methyladenosine
  modified_base (16)..(16): 2'-O-methyladenosine
  modified_base (31)..(31): 2'-O-methyladenosine
  modified_base (35)..(35): 2'-O-methyladenosine

SEQ ID NO: 133 - RNA, 65 nt, Artificial Sequence; identical to SEQ ID NO: 3
  E22-2
  misc_feature (1)..(1): 5'-phosphorylated

SEQ ID NO: 134 - RNA, 145 nt, Artificial Sequence; identical to SEQ ID NO: 1
  E23
  modified_base (4)..(4): 2'-deoxy-2'-fluoroadenosine
  modified_base (6)..(6): 2'-deoxy-2'-fluoroadenosine
  modified_base (7)..(7): 2'-deoxy-2'-fluoroadenosine
  modified_base (9)..(9): 2'-deoxy-2'-fluoroadenosine
  modified_base (11)..(11): 2'-deoxy-2'-fluoroadenosine
  modified_base (12)..(12): 2'-deoxy-2'-fluoroadenosine
  modified_base (16)..(16): 2'-deoxy-2'-fluoroadenosine
  modified_base (31)..(31): 2'-deoxy-2'-fluoroadenosine
  modified_base (35)..(35): 2'-deoxy-2'-fluoroadenosine

SEQ ID NO: 135 - RNA, 80 nt, Artificial Sequence; identical to SEQ ID NO: 2
  E23-1
  modified_base (4)..(4): 2'-deoxy-2'-fluoroadenosine
  modified_base (6)..(6): 2'-deoxy-2'-fluoroadenosine
  modified_base (7)..(7): 2'-deoxy-2'-fluoroadenosine
  modified_base (9)..(9): 2'-deoxy-2'-fluoroadenosine
  modified_base (11)..(11): 2'-deoxy-2'-fluoroadenosine
  modified_base (12)..(12): 2'-deoxy-2'-fluoroadenosine
  modified_base (16)..(16): 2'-deoxy-2'-fluoroadenosine
  modified_base (31)..(31): 2'-deoxy-2'-fluoroadenosine
  modified_base (35)..(35): 2'-deoxy-2'-fluoroadenosine

SEQ ID NO: 136 - RNA, 65 nt, Artificial Sequence; identical to SEQ ID NO: 3
  E23-2
  misc_feature (1)..(1): 5'-phosphorylated

SEQ ID NO: 137 - RNA, 145 nt, Artificial Sequence; identical to SEQ ID NO: 1
  E24
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (112)..(112): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 138 - RNA, 80 nt, Artificial Sequence; identical to SEQ ID NO: 2
  E24-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 139 - RNA, 65 nt, Artificial Sequence; identical to SEQ ID NO: 3
  E24-2
  misc_feature (1)..(1): 5'-phosphorylated
  modified_base (32)..(32): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 140 - RNA, 145 nt, Artificial Sequence; identical to SEQ ID NO: 1
  E25
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (112)..(112): 2'-deoxy-2'-fluorocytidine
  modified_base (115)..(115): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 141 - RNA, 80 nt, Artificial Sequence; identical to SEQ ID NO: 2
  E25-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 142 - RNA, 65 nt, Artificial Sequence; identical to SEQ ID NO: 3
  E25-2
  misc_feature (1)..(1): 5'-phosphorylated
  modified_base (32)..(32): 2'-deoxy-2'-fluorocytidine
  modified_base (35)..(35): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 143 - RNA, 145 nt, Artificial Sequence; identical to SEQ ID NO: 1
  E26
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (110)..(110): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 144 - RNA, 80 nt, Artificial Sequence; identical to SEQ ID NO: 2
  E26-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 145 - RNA, 65 nt, Artificial Sequence; identical to SEQ ID NO: 3
  E26-2
  misc_feature (1)..(1): 5'-phosphorylated
  modified_base (30)..(30): 2'-O-methylguanosine
  modified_base (63)..(63): 2'-O-methyluridine
  modified_base (64)..(64): 2'-O-methylguanosine
  modified_base (65)..(65): 2'-O-methyladenosine

SEQ ID NO: 146 - RNA, 145 nt, Artificial Sequence; identical to SEQ ID NO: 1
  E27
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (110)..(110): 2'-O-methylguanosine
  modified_base (113)..(113): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 147 - RNA, 80 nt, Artificial Sequence; identical to SEQ ID NO: 2
  E27-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 148 - RNA, 65 nt, Artificial Sequence; identical to SEQ ID NO: 3
  E27-2
  misc_feature (1)..(1): 5'-phosphorylated
  modified_base (30)..(30): 2'-O-methylguanosine
  modified_base (33)..(33): 2'-O-methylguanosine
  modified_base (63)..(63): 2'-O-methyluridine
  modified_base (64)..(64): 2'-O-methylguanosine
  modified_base (65)..(65): 2'-O-methyladenosine

SEQ ID NO: 149 - RNA, 145 nt, Artificial Sequence; identical to SEQ ID NO: 1
  E28
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (112)..(112): 2'-O-methylcytidine
  modified_base (143)..(143): 2'-O-methyluridine
  modified_base (144)..(144): 2'-O-methylguanosine
  modified_base (145)..(145): 2'-O-methyladenosine

SEQ ID NO: 150 - RNA, 80 nt, Artificial Sequence; identical to SEQ ID NO: 2
  E28-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 151 - RNA, 65 nt, Artificial Sequence; identical to SEQ ID NO: 3
  E28-2
  misc_feature (1)..(1): 5'-phosphorylated
  modified_base (32)..(32): 2'-O-methylcytidine
  modified_base (63)..(63): 2'-O-methyluridine
  modified_base (64)..(64): 2'-O-methylguanosine
  modified_base (65)..(65): 2'-O-methyladenosine

SEQ ID NO: 152 - RNA, 145 nt, Artificial Sequence; identical to SEQ ID NO: 1
  E29
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (110)..(110): 2'-O-methylguanosine
  modified_base (113)..(113): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 153 - RNA, 80 nt, Artificial Sequence; identical to SEQ ID NO: 2
  E29-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 154 - RNA, 65 nt, Artificial Sequence; identical to SEQ ID NO: 3
  E29-2
  misc_feature (1)..(1): 5'-phosphorylated
  modified_base (32)..(32): 2'-O-methylcytidine
  modified_base (35)..(35): 2'-O-methylcytidine
  modified_base (63)..(63): 2'-O-methyluridine
  modified_base (64)..(64): 2'-O-methylguanosine
  modified_base (65)..(65): 2'-O-methyladenosine

SEQ ID NO: 155 - RNA, 145 nt, Artificial Sequence; identical to SEQ ID NO: 1
  E30
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (143)..(143): 2'-O-methyluridine
  modified_base (144)..(144): 2'-O-methylguanosine
  modified_base (145)..(145): 2'-O-methyladenosine

SEQ ID NO: 156 - RNA, 80 nt, Artificial Sequence; identical to SEQ ID NO: 2
  E30-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 157 - RNA, 65 nt, Artificial Sequence; identical to SEQ ID NO: 3
  E30-2
  misc_feature (1)..(1): 5'-phosphorylated
  modified_base (63)..(63): 2'-O-methyluridine
  modified_base (64)..(64): 2'-O-methylguanosine
  modified_base (65)..(65): 2'-O-methyladenosine

SEQ ID NO: 158 - RNA, 145 nt, Artificial Sequence; identical to SEQ ID NO: 1
  E31
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (143)..(143): 2'-O-methyluridine
  modified_base (144)..(144): 2'-O-methylguanosine
  modified_base (145)..(145): 2'-O-methyladenosine

SEQ ID NO: 159 - RNA, 80 nt, Artificial Sequence; identical to SEQ ID NO: 2
  E31-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 160 - RNA, 65 nt, Artificial Sequence; identical to SEQ ID NO: 3
  E31-2
  misc_feature (1)..(1): 5'-phosphorylated
  modified_base (63)..(63): 2'-O-methyluridine
  modified_base (64)..(64): 2'-O-methylguanosine
  modified_base (65)..(65): 2'-O-methyladenosine

SEQ ID NO: 161 - RNA, 145 nt, Artificial Sequence; identical to SEQ ID NO: 1
  E32
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  misc_feature (110)..(110): LNA
  modified_base (143)..(143): 2'-O-methyluridine
  modified_base (144)..(144): 2'-O-methylguanosine
  modified_base (145)..(145): 2'-O-methyladenosine

SEQ ID NO: 162 - RNA, 80 nt, Artificial Sequence; identical to SEQ ID NO: 2
  E32-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 163 - RNA, 65 nt, Artificial Sequence; identical to SEQ ID NO: 3
  E32-2
  misc_feature (1)..(1): 5'-phosphorylated
  misc_feature (30)..(30): LNA
  modified_base (63)..(63): 2'-O-methyluridine
  modified_base (64)..(64): 2'-O-methylguanosine
  modified_base (65)..(65): 2'-O-methyladenosine

SEQ ID NO: 164 - RNA, 145 nt, Artificial Sequence; identical to SEQ ID NO: 1
  E33
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  misc_feature (110)..(110): LNA
  misc_feature (113)..(113): LNA
  modified_base (143)..(143): 2'-O-methyluridine
  modified_base (144)..(144): 2'-O-methylguanosine
  modified_base (145)..(145): 2'-O-methyladenosine

SEQ ID NO: 165 - RNA, 80 nt, Artificial Sequence; identical to SEQ ID NO: 2
  E33-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 166 - RNA, 65 nt, Artificial Sequence; identical to SEQ ID NO: 3
  E33-2
  misc_feature (1)..(1): 5'-phosphorylated
  misc_feature (30)..(30): LNA
  misc_feature (33)..(33): LNA
  modified_base (63)..(63): 2'-O-methyluridine
  modified_base (64)..(64): 2'-O-methylguanosine
  modified_base (65)..(65): 2'-O-methyladenosine

SEQ ID NO: 167 - RNA, 145 nt, Artificial Sequence; identical to SEQ ID NO: 1
  E34
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  misc_feature (112)..(112): LNA
  modified_base (143)..(143): 2'-O-methyluridine
  modified_base (144)..(144): 2'-O-methylguanosine
  modified_base (145)..(145): 2'-O-methyladenosine

SEQ ID NO: 168 - RNA, 80 nt, Artificial Sequence; identical to SEQ ID NO: 2
  E34-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 169 - RNA, 65 nt, Artificial Sequence; identical to SEQ ID NO: 3
  E34-2
  misc_feature (1)..(1): 5'-phosphorylated
  misc_feature (32)..(32): LNA
  modified_base (63)..(63): 2'-O-methyluridine
  modified_base (64)..(64): 2'-O-methylguanosine
  modified_base (65)..(65): 2'-O-methyladenosine

SEQ ID NO: 170 - RNA, 145 nt, Artificial Sequence; identical to SEQ ID NO: 1
  E35
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  misc_feature (112)..(112): LNA
  misc_feature (115)..(115): LNA
  modified_base (143)..(143): 2'-O-methyluridine
  modified_base (144)..(144): 2'-O-methylguanosine
  modified_base (145)..(145): 2'-O-methyladenosine

SEQ ID NO: 171 - RNA, 80 nt, Artificial Sequence; identical to SEQ ID NO: 2
  E35-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 172 - RNA, 65 nt, Artificial Sequence; identical to SEQ ID NO: 3
  E35-2
  misc_feature (1)..(1): 5'-phosphorylated
  misc_feature (32)..(32): LNA
  misc_feature (35)..(35): LNA
  modified_base (63)..(63): 2'-O-methyluridine
  modified_base (64)..(64): 2'-O-methylguanosine
  modified_base (65)..(65): 2'-O-methyladenosine

SEQ ID NO: 173 - RNA, 145 nt, Artificial Sequence; identical to SEQ ID NO: 1
  E36
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (111)..(111): 2'-O-methyladenosine
  modified_base (143)..(143): 2'-O-methyluridine
  modified_base (144)..(144): 2'-O-methylguanosine
  modified_base (145)..(145): 2'-O-methyladenosine

SEQ ID NO: 174 - RNA, 80 nt, Artificial Sequence; identical to SEQ ID NO: 2
  E36-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 175 - RNA, 65 nt, Artificial Sequence; identical to SEQ ID NO: 3
  E36-2
  misc_feature (1)..(1): 5'-phosphorylated
  modified_base (31)..(31): 2'-O-methyladenosine
  modified_base (63)..(63): 2'-O-methyluridine
  modified_base (64)..(64): 2'-O-methylguanosine
  modified_base (65)..(65): 2'-O-methyladenosine

SEQ ID NO: 176 - RNA, 145 nt, Artificial Sequence; identical to SEQ ID NO: 1
  E37
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (111)..(111): 2'-deoxy-2'-fluoroadenosine
  modified_base (143)..(143): 2'-O-methyluridine
  modified_base (144)..(144): 2'-O-methylguanosine
  modified_base (145)..(145): 2'-O-methyladenosine

SEQ ID NO: 177 - RNA, 80 nt, Artificial Sequence; identical to SEQ ID NO: 2
  E37-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 178 - RNA, 65 nt, Artificial Sequence; identical to SEQ ID NO: 3
  E37-2
  misc_feature (1)..(1): 5'-phosphorylated
  modified_base (31)..(31): 2'-deoxy-2'-fluoroadenosine
  modified_base (63)..(63): 2'-O-methyluridine
  modified_base (64)..(64): 2'-O-methylguanosine
  modified_base (65)..(65): 2'-O-methyladenosine

SEQ ID NO: 179 - RNA, 145 nt, Artificial Sequence; identical to SEQ ID NO: 1
  E38
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (110)..(110): 2'-deoxy-2'-fluoroguanosine
  modified_base (143)..(143): 2'-O-methyluridine
  modified_base (144)..(144): 2'-O-methylguanosine
  modified_base (145)..(145): 2'-O-methyladenosine

SEQ ID NO: 180 - RNA, 80 nt, Artificial Sequence; identical to SEQ ID NO: 2
  E38-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 181 - RNA, 65 nt, Artificial Sequence; identical to SEQ ID NO: 3
  E38-2
  misc_feature (1)..(1): 5'-phosphorylated
  modified_base (30)..(30): 2'-deoxy-2'-fluoroguanosine
  modified_base (63)..(63): 2'-O-methyluridine
  modified_base (64)..(64): 2'-O-methylguanosine
  modified_base (65)..(65): 2'-O-methyladenosine

SEQ ID NO: 182 - RNA, 145 nt, Artificial Sequence; identical to SEQ ID NO: 1
  E39
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (110)..(110): 2'-deoxy-2'-fluoroguanosine
  modified_base (113)..(113): 2'-deoxy-2'-fluoroguanosine
  modified_base (143)..(143): 2'-O-methyluridine
  modified_base (144)..(144): 2'-O-methylguanosine
  modified_base (145)..(145): 2'-O-methyladenosine

SEQ ID NO: 183 - RNA, 80 nt, Artificial Sequence; identical to SEQ ID NO: 2
  E39-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 184 - RNA, 65 nt, Artificial Sequence; identical to SEQ ID NO: 3
  E39-2
  misc_feature (1)..(1): 5'-phosphorylated
  modified_base (30)..(30): 2'-deoxy-2'-fluoroguanosine
  modified_base (33)..(33): 2'-deoxy-2'-fluoroguanosine
  modified_base (63)..(63): 2'-O-methyluridine
  modified_base (64)..(64): 2'-O-methylguanosine
  modified_base (65)..(65): 2'-O-methyladenosine

SEQ ID NO: 185 - RNA, 145 nt, Artificial Sequence; identical to SEQ ID NO: 1
  E40
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (112)..(112): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 186 - RNA, 80 nt, Artificial Sequence; identical to SEQ ID NO: 2
  E40-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 187 - RNA, 65 nt, Artificial Sequence; identical to SEQ ID NO: 3
  E40-2
  misc_feature (1)..(1): 5'-phosphorylated
  modified_base (32)..(32): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 188 - RNA, 145 nt, Artificial Sequence; identical to SEQ ID NO: 1
  E41
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (112)..(112): 2'-deoxy-2'-fluorocytidine
  modified_base (115)..(115): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 189 - RNA, 80 nt, Artificial Sequence; identical to SEQ ID NO: 2
  E41-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 190 - RNA, 65 nt, Artificial Sequence; identical to SEQ ID NO: 3
  E41-2
  misc_feature (1)..(1): 5'-phosphorylated
  modified_base (32)..(32): 2'-deoxy-2'-fluorocytidine
  modified_base (35)..(35): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 191 - RNA, 145 nt, Artificial Sequence; identical to SEQ ID NO: 1
  E42
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (110)..(110): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 192 - RNA, 80 nt, Artificial Sequence; identical to SEQ ID NO: 2
  E42-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 193 - RNA, 65 nt, Artificial Sequence; identical to SEQ ID NO: 3
  E42-2
  misc_feature (1)..(1): 5'-phosphorylated
  modified_base (30)..(30): 2'-O-methylguanosine
  modified_base (63)..(63): 2'-O-methyluridine
  modified_base (64)..(64): 2'-O-methylguanosine
  modified_base (65)..(65): 2'-O-methyladenosine

SEQ ID NO: 194 - RNA, 145 nt, Artificial Sequence; identical to SEQ ID NO: 1
  E43
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (110)..(110): 2'-O-methylguanosine
  modified_base (113)..(113): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 195 - RNA, 80 nt, Artificial Sequence; identical to SEQ ID NO: 2
  E43-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 196 - RNA, 65 nt, Artificial Sequence; identical to SEQ ID NO: 3
  E43-2
  misc_feature (1)..(1): 5'-phosphorylated
  modified_base (30)..(30): 2'-O-methylguanosine
  modified_base (33)..(33): 2'-O-methylguanosine
  modified_base (63)..(63): 2'-O-methyluridine
  modified_base (64)..(64): 2'-O-methylguanosine
  modified_base (65)..(65): 2'-O-methyladenosine

SEQ ID NO: 197 - RNA, 145 nt, Artificial Sequence; identical to SEQ ID NO: 1
  E44
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (112)..(112): 2'-O-methylcytidine
  modified_base (143)..(143): 2'-O-methyluridine
  modified_base (144)..(144): 2'-O-methylguanosine
  modified_base (145)..(145): 2'-O-methyladenosine

SEQ ID NO: 198 - RNA, 80 nt, Artificial Sequence; identical to SEQ ID NO: 2
  E44-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 199 - RNA, 65 nt, Artificial Sequence; identical to SEQ ID NO: 3
  E44-2
  misc_feature (1)..(1): 5'-phosphorylated
  modified_base (32)..(32): 2'-O-methylcytidine
  modified_base (63)..(63): 2'-O-methyluridine
  modified_base (64)..(64): 2'-O-methylguanosine
  modified_base (65)..(65): 2'-O-methyladenosine

SEQ ID NO: 200 - RNA, 145 nt, Artificial Sequence; identical to SEQ ID NO: 1
  E45
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (112)..(112): 2'-O-methylcytidine
  modified_base (115)..(115): 2'-O-methylcytidine
  modified_base (143)..(143): 2'-O-methyluridine
  modified_base (144)..(144): 2'-O-methylguanosine
  modified_base (145)..(145): 2'-O-methyladenosine

SEQ ID NO: 201 - RNA, 80 nt, Artificial Sequence; identical to SEQ ID NO: 2
  E45-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 202 - RNA, 65 nt, Artificial Sequence; identical to SEQ ID NO: 3
  E45-2
  misc_feature (1)..(1): 5'-phosphorylated
  modified_base (32)..(32): 2'-O-methylcytidine
  modified_base (35)..(35): 2'-O-methylcytidine
  modified_base (63)..(63): 2'-O-methyluridine
  modified_base (64)..(64): 2'-O-methylguanosine
  modified_base (65)..(65): 2'-O-methyladenosine

SEQ ID NO: 203 - RNA, 165 nt, Artificial Sequence; identical to SEQ ID NO: 5
  E46
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (143)..(143): 2'-O-methyluridine
  modified_base (144)..(144): 2'-O-methylguanosine
  modified_base (145)..(145): 2'-O-methyladenosine

SEQ ID NO: 204 - RNA, 80 nt, Artificial Sequence; identical to SEQ ID NO: 2
  E46-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 205 - RNA, 85 nt, Artificial Sequence; identical to SEQ ID NO: 7
  E46-2
  misc_feature (1)..(1): 5'-phosphorylated
  modified_base (63)..(63): 2'-O-methyluridine
  modified_base (64)..(64): 2'-O-methylguanosine
  modified_base (65)..(65): 2'-O-methyladenosine

SEQ ID NO: 206 - RNA, 145 nt, Artificial Sequence; identical to SEQ ID NO: 1
  E47
  misc_feature (1)..(1): LNA
  misc_feature (2)..(2): LNA
  misc_feature (3)..(3): LNA
  misc_feature (4)..(4): LNA
  misc_feature (5)..(5): LNA
  misc_feature (6)..(6): LNA
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  misc_feature (143)..(143): LNA
  misc_feature (144)..(144): LNA
  misc_feature (145)..(145): LNA

SEQ ID NO: 207 - RNA, 80 nt, Artificial Sequence; identical to SEQ ID NO: 2
  E47-1
  misc_feature (1)..(1): LNA
  misc_feature (2)..(2): LNA
  misc_feature (3)..(3): LNA
  misc_feature (4)..(4): LNA
  misc_feature (5)..(5): LNA
  misc_feature (6)..(6): LNA
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 208 - RNA, 65 nt, Artificial Sequence; identical to SEQ ID NO: 3
  E47-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  misc_feature (63)..(63): LNA
  misc_feature (64)..(64): LNA
  misc_feature (65)..(65): LNA

SEQ ID NO: 209 - RNA, 145 nt, Artificial Sequence; identical to SEQ ID NO: 1
  E48
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methoxyethyluridine
  modified_base (144)..(144): 2'-O-methoxyethylguanosine
  modified_base (145)..(145): 2'-O-methoxyethyladenosine

SEQ ID NO: 210 - RNA, 80 nt, Artificial Sequence; identical to SEQ ID NO: 2
  E48-1
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 211 - RNA, 65 nt, Artificial Sequence; identical to SEQ ID NO: 3
  E48-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methoxyethyluridine
  modified_base (64)..(64): 2'-O-methoxyethylguanosine
  modified_base (65)..(65): 2'-O-methoxyethyladenosine

SEQ ID NO: 212 - RNA, 165 nt, Artificial Sequence; identical to SEQ ID NO: 5
  E49
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methoxyethyluridine
  modified_base (144)..(144): 2'-O-methoxyethylguanosine
  modified_base (145)..(145): 2'-O-methoxyethyladenosine

SEQ ID NO: 213 - RNA, 80 nt, Artificial Sequence; identical to SEQ ID NO: 2
  E49-1
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 214 - RNA, 85 nt, Artificial Sequence; identical to SEQ ID NO: 7
  E49-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methoxyethyluridine
  modified_base (64)..(64): 2'-O-methoxyethylguanosine
  modified_base (65)..(65): 2'-O-methoxyethyladenosine

SEQ ID NO: 215 - RNA, 165 nt, Artificial Sequence; identical to SEQ ID NO: 5
  E50
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorouridine
  modified_base (146)..(146): 2'-deoxy-2'-fluoroadenosine
  modified_base (149)..(149): 2'-deoxy-2'-fluoroadenosine
  modified_base (152)..(152): 2'-deoxy-2'-fluoroadenosine
  modified_base (155)..(155): 2'-deoxy-2'-fluoroadenosine
  modified_base (158)..(158): 2'-deoxy-2'-fluoroadenosine
  modified_base (161)..(161): 2'-deoxy-2'-fluoroadenosine
  modified_base (163)..(163): 2'-O-methoxyethyladenosine
  modified_base (164)..(164): 2'-O-methoxyethyladenosine
  modified_base (165)..(165): 2'-O-methoxyethyladenosine

SEQ ID NO: 216 - RNA, 80 nt, Artificial Sequence; identical to SEQ ID NO: 2
  E50-1
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 217 - RNA, 85 nt, Artificial Sequence; identical to SEQ ID NO: 7
  E50-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine
  modified_base (66)..(66): 2'-deoxy-2'-fluoroadenosine
  modified_base (69)..(69): 2'-deoxy-2'-fluoroadenosine
  modified_base (72)..(72): 2'-deoxy-2'-fluoroadenosine
  modified_base (75)..(75): 2'-deoxy-2'-fluoroadenosine
  modified_base (78)..(78): 2'-deoxy-2'-fluoroadenosine
  modified_base (81)..(81): 2'-deoxy-2'-fluoroadenosine
  modified_base (83)..(83): 2'-O-methoxyethyladenosine
  modified_base (84)..(84): 2'-O-methoxyethyladenosine
  modified_base (85)..(85): 2'-O-methoxyethyladenosine

SEQ ID NO: 218 - RNA, 165 nt, Artificial Sequence; identical to SEQ ID NO: 5
  E51
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methoxyethyluridine
  modified_base (144)..(144): 2'-O-methoxyethylguanosine
  modified_base (145)..(145): 2'-O-methoxyethyladenosine
  modified_base (146)..(146): 2'-deoxy-2'-fluoroadenosine
  modified_base (149)..(149): 2'-deoxy-2'-fluoroadenosine
  modified_base (152)..(152): 2'-deoxy-2'-fluoroadenosine
  modified_base (155)..(155): 2'-deoxy-2'-fluoroadenosine
  modified_base (158)..(158): 2'-deoxy-2'-fluoroadenosine
  modified_base (161)..(161): 2'-deoxy-2'-fluoroadenosine
  modified_base (163)..(163): 2'-O-methoxyethyladenosine
  modified_base (164)..(164): 2'-O-methoxyethyladenosine
  modified_base (165)..(165): 2'-O-methoxyethyladenosine

SEQ ID NO: 219 - RNA, 80 nt, Artificial Sequence; identical to SEQ ID NO: 2
  E51-1
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 220 - RNA, 85 nt, Artificial Sequence; identical to SEQ ID NO: 7
  E51-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methoxyethyluridine
  modified_base (64)..(64): 2'-O-methoxyethylguanosine
  modified_base (65)..(65): 2'-O-methoxyethyladenosine
  modified_base (66)..(66): 2'-deoxy-2'-fluoroadenosine
  modified_base (69)..(69): 2'-deoxy-2'-fluoroadenosine
  modified_base (72)..(72): 2'-deoxy-2'-fluoroadenosine
  modified_base (75)..(75): 2'-deoxy-2'-fluoroadenosine
  modified_base (78)..(78): 2'-deoxy-2'-fluoroadenosine
  modified_base (81)..(81): 2'-deoxy-2'-fluoroadenosine
  modified_base (83)..(83): 2'-O-methoxyethyladenosine
  modified_base (84)..(84): 2'-O-methoxyethyladenosine
  modified_base (85)..(85): 2'-O-methoxyethyladenosine

SEQ ID NO: 221 - RNA, 165 nt, Artificial Sequence; identical to SEQ ID NO: 5
  E52
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorouridine
  modified_base (146)..(146): 2'-deoxy-2'-fluoroadenosine
  modified_base (149)..(149): 2'-deoxy-2'-fluoroadenosine
  modified_base (152)..(152): 2'-deoxy-2'-fluoroadenosine
  modified_base (155)..(155): 2'-deoxy-2'-fluoroadenosine
  modified_base (158)..(158): 2'-deoxy-2'-fluoroadenosine
  modified_base (161)..(161): 2'-deoxy-2'-fluoroadenosine
  misc_feature (163)..(164): 5'-phosphonothioate
  modified_base (163)..(163): 2'-O-methoxyethyladenosine
  misc_feature (164)..(165): 5'-phosphonothioate
  modified_base (164)..(164): 2'-O-methoxyethyladenosine
  modified_base (165)..(165): 2'-O-methoxyethyladenosine

SEQ ID NO: 222 - RNA, 80 nt, Artificial Sequence; identical to SEQ ID NO: 2
  E52-1
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 223 - RNA, 85 nt, Artificial Sequence; identical to SEQ ID NO: 7
  E52-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine
  modified_base (66)..(66): 2'-deoxy-2'-fluoroadenosine
  modified_base (69)..(69): 2'-deoxy-2'-fluoroadenosine
  modified_base (72)..(72): 2'-deoxy-2'-fluoroadenosine
  modified_base (75)..(75): 2'-deoxy-2'-fluoroadenosine
  modified_base (78)..(78): 2'-deoxy-2'-fluoroadenosine
  modified_base (81)..(81): 2'-deoxy-2'-fluoroadenosine
  misc_feature (83)..(84): 5'-phosphonothioate
  modified_base (83)..(83): 2'-O-methoxyethyladenosine
  misc_feature (84)..(85): 5'-phosphonothioate
  modified_base (84)..(84): 2'-O-methoxyethyladenosine
  modified_base (85)..(85): 2'-O-methoxyethyladenosine

SEQ ID NO: 224 - RNA, 165 nt, Artificial Sequence; identical to SEQ ID NO: 5
  E53
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  misc_feature (143)..(144): 5'-phosphonothioate
  modified_base (143)..(143): 2'-O-methoxyethyluridine
  misc_feature (144)..(145): 5'-phosphonothioate
  modified_base (144)..(144): 2'-O-methoxyethylguanosine
  modified_base (145)..(145): 2'-O-methoxyethyladenosine
  modified_base (146)..(146): 2'-deoxy-2'-fluoroadenosine
  modified_base (149)..(149): 2'-deoxy-2'-fluoroadenosine
  modified_base (152)..(152): 2'-deoxy-2'-fluoroadenosine
  modified_base (155)..(155): 2'-deoxy-2'-fluoroadenosine
  modified_base (158)..(158): 2'-deoxy-2'-fluoroadenosine
  modified_base (161)..(161): 2'-deoxy-2'-fluoroadenosine
  misc_feature (163)..(164): 5'-phosphonothioate
  modified_base (163)..(163): 2'-O-methoxyethyladenosine
  misc_feature (164)..(165): 5'-phosphonothioate
  modified_base (164)..(164): 2'-O-methoxyethyladenosine
  modified_base (165)..(165): 2'-O-methoxyethyladenosine

SEQ ID NO: 225 - RNA, 80 nt, Artificial Sequence; identical to SEQ ID NO: 2
  E53-1
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 226 - RNA, 85 nt, Artificial Sequence; identical to SEQ ID NO: 7
  E53-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  misc_feature (63)..(64): 5'-phosphonothioate
  modified_base (63)..(63): 2'-O-methoxyethyluridine
  misc_feature (64)..(65): 5'-phosphonothioate
  modified_base (64)..(64): 2'-O-methoxyethylguanosine
  modified_base (65)..(65): 2'-O-methoxyethyladenosine
  modified_base (66)..(66): 2'-deoxy-2'-fluoroadenosine
  modified_base (69)..(69): 2'-deoxy-2'-fluoroadenosine
  modified_base (72)..(72): 2'-deoxy-2'-fluoroadenosine
  modified_base (75)..(75): 2'-deoxy-2'-fluoroadenosine
  modified_base (78)..(78): 2'-deoxy-2'-fluoroadenosine
  modified_base (81)..(81): 2'-deoxy-2'-fluoroadenosine
  misc_feature (83)..(84): 5'-phosphonothioate
  modified_base (83)..(83): 2'-O-methoxyethyladenosine
  misc_feature (84)..(85): 5'-phosphonothioate
  modified_base (84)..(84): 2'-O-methoxyethyladenosine
  modified_base (85)..(85): 2'-O-methoxyethyladenosine

SEQ ID NO: 227 - RNA, 165 nt, Artificial Sequence; identical to SEQ ID NO: 5
  E54
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 228 - RNA, 80 nt, Artificial Sequence; identical to SEQ ID NO: 2
  E54-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 229 - RNA, 85 nt, Artificial Sequence; identical to SEQ ID NO: 7
  E54-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 230 - RNA, 143 nt, Artificial Sequence
  E55
  modified_base (4)..(4): N6-methy-2'-O-methyladenosine
  modified_base (6)..(6): N6-methy-2'-O-methyladenosine
  modified_base (7)..(7): N6-methy-2'-O-methyladenosine
  modified_base (9)..(9): N6-methy-2'-O-methyladenosine
  modified_base (11)..(11): N6-methy-2'-O-methyladenosine
  modified_base (12)..(12): N6-methy-2'-O-methyladenosine
  modified_base (16)..(16): N6-methy-2'-O-methyladenosine
  modified_base (31)..(31): N6-methy-2'-O-methyladenosine
  modified_base (35)..(35): N6-methy-2'-O-methyladenosine
gggagaauacaagcuacuuguucuuuuugcagccaccauggacuacaaggacgacgacgacaagaucaucgacuauaaacgacgacgauaaagguggcgacuauaaggacgacgacgacaaacaccaccaccaccaccacuga

SEQ ID NO: 231 - RNA, 80 nt, Artificial Sequence; identical to SEQ ID NO: 2
  E55-1
  modified_base (4)..(4): N6-methy-2'-O-methyladenosine
  modified_base (6)..(6): N6-methy-2'-O-methyladenosine
  modified_base (7)..(7): N6-methy-2'-O-methyladenosine
  modified_base (9)..(9): N6-methy-2'-O-methyladenosine
  modified_base (11)..(11): N6-methy-2'-O-methyladenosine
  modified_base (12)..(12): N6-methy-2'-O-methyladenosine
  modified_base (16)..(16): N6-methy-2'-O-methyladenosine
  modified_base (31)..(31): N6-methy-2'-O-methyladenosine
  modified_base (35)..(35): N6-methy-2'-O-methyladenosine

SEQ ID NO: 232 - RNA, 65 nt, Artificial Sequence; identical to SEQ ID NO: 3
  E55-2
  misc_feature (1)..(1): 5'-phosphorylated

SEQ ID NO: 233 - RNA, 145 nt, Artificial Sequence; identical to SEQ ID NO: 1
  E56
  modified_base (4)..(4): N6-methy-2'-deoxy-2'-fluoroadenosine
  modified_base (6)..(6): N6-methy-2'-deoxy-2'-fluoroadenosine
  modified_base (7)..(7): N6-methy-2'-deoxy-2'-fluoroadenosine
  modified_base (9)..(9): N6-methy-2'-deoxy-2'-fluoroadenosine
  modified_base (11)..(11): N6-methy-2'-deoxy-2'-fluoroadenosine
  modified_base (12)..(12): N6-methy-2'-deoxy-2'-fluoroadenosine
  modified_base (16)..(16): N6-methy-2'-deoxy-2'-fluoroadenosine
  modified_base (31)..(31): N6-methy-2'-deoxy-2'-fluoroadenosine
  modified_base (35)..(35): N6-methy-2'-deoxy-2'-fluoroadenosine

SEQ ID NO: 234 - RNA, 80 nt, Artificial Sequence; identical to SEQ ID NO: 2
  E56-1
  modified_base (4)..(4): N6-methy-2'-deoxy-2'-fluoroadenosine
  modified_base (6)..(6): N6-methy-2'-deoxy-2'-fluoroadenosine
  modified_base (7)..(7): N6-methy-2'-deoxy-2'-fluoroadenosine
  modified_base (9)..(9): N6-methy-2'-deoxy-2'-fluoroadenosine
  modified_base (11)..(11): N6-methy-2'-deoxy-2'-fluoroadenosine
  modified_base (12)..(12): N6-methy-2'-deoxy-2'-fluoroadenosine
  modified_base (16)..(16): N6-methy-2'-deoxy-2'-fluoroadenosine
  modified_base (31)..(31): N6-methy-2'-deoxy-2'-fluoroadenosine
  modified_base (35)..(35): N6-methy-2'-deoxy-2'-fluoroadenosine

SEQ ID NO: 235 - RNA, 65 nt, Artificial Sequence; identical to SEQ ID NO: 3
  E56-2
  misc_feature (1)..(1): 5'-phosphorylated

SEQ ID NO: 236 - RNA, 145 nt, Artificial Sequence; identical to SEQ ID NO: 1
  E57
  modified_base (4)..(4): N6-ethy-2'-O-methyladenosine
  modified_base (6)..(6): N6-ethy-2'-O-methyladenosine
  modified_base (7)..(7): N6-ethy-2'-O-methyladenosine
  modified_base (9)..(9): N6-ethy-2'-O-methyladenosine
  modified_base (11)..(11): N6-ethy-2'-O-methyladenosine
  modified_base (12)..(12): N6-ethy-2'-O-methyladenosine
  modified_base (16)..(16): N6-ethy-2'-O-methyladenosine
  modified_base (31)..(31): N6-ethy-2'-O-methyladenosine
  modified_base (35)..(35): N6-ethy-2'-O-methyladenosine

SEQ ID NO: 237 - RNA, 80 nt, Artificial Sequence; identical to SEQ ID NO: 2
  E57-1
  modified_base (4)..(4): N6-ethy-2'-O-methyladenosine
  modified_base (6)..(6): N6-ethy-2'-O-methyladenosine
  modified_base (7)..(7): N6-ethy-2'-O-methyladenosine
  modified_base (9)..(9): N6-ethy-2'-O-methyladenosine
  modified_base (11)..(11): N6-ethy-2'-O-methyladenosine
  modified_base (12)..(12): N6-ethy-2'-O-methyladenosine
  modified_base (16)..(16): N6-ethy-2'-O-methyladenosine
  modified_base (31)..(31): N6-ethy-2'-O-methyladenosine
  modified_base (35)..(35): N6-ethy-2'-O-methyladenosine

SEQ ID NO: 238 - RNA, 65 nt, Artificial Sequence; identical to SEQ ID NO: 3
  E57-2
  misc_feature (1)..(1): 5'-phosphorylated

SEQ ID NO: 239 - RNA, 145 nt, Artificial Sequence; identical to SEQ ID NO: 1
  E58 N6-ethy-
  modified_base (4)..(4): 2'-deoxy-2'-fluoroadenosineN6-ethy-
  modified_base (6)..(6): 2'-deoxy-2'-fluoroadenosineN6-ethy-
  modified_base (7)..(7): 2'-deoxy-2'-fluoroadenosineN6-ethy-
  modified_base (9)..(9): 2'-deoxy-2'-fluoroadenosineN6-ethy-
  modified_base (11)..(11): 2'-deoxy-2'-fluoroadenosineN6-ethy-
  modified_base (12)..(12): 2'-deoxy-2'-fluoroadenosineN6-ethy-
  modified_base (16)..(16): 2'-deoxy-2'-fluoroadenosineN6-ethy-
  modified_base (31)..(31): 2'-deoxy-2'-fluoroadenosineN6-ethy-
  modified_base (35)..(35): 2'-deoxy-2'-fluoroadenosine

SEQ ID NO: 240 - RNA, 80 nt, Artificial Sequence; identical to SEQ ID NO: 2
  E58-1 N6-ethy-
  modified_base (4)..(4): 2'-deoxy-2'-fluoroadenosineN6-ethy-
  modified_base (6)..(6): 2'-deoxy-2'-fluoroadenosineN6-ethy-
  modified_base (7)..(7): 2'-deoxy-2'-fluoroadenosineN6-ethy-
  modified_base (9)..(9): 2'-deoxy-2'-fluoroadenosineN6-ethy-
  modified_base (11)..(11): 2'-deoxy-2'-fluoroadenosineN6-ethy-
  modified_base (12)..(12): 2'-deoxy-2'-fluoroadenosineN6-ethy-
  modified_base (16)..(16): 2'-deoxy-2'-fluoroadenosineN6-ethy-
  modified_base (31)..(31): 2'-deoxy-2'-fluoroadenosineN6-ethy-
  modified_base (35)..(35): 2'-deoxy-2'-fluoroadenosine

SEQ ID NO: 241 - RNA, 65 nt, Artificial Sequence; identical to SEQ ID NO: 3
  E58-2
  misc_feature (1)..(1): 5'-phosphorylated

SEQ ID NO: 242 - RNA, 145 nt, Artificial Sequence; identical to SEQ ID NO: 1
  E59
  modified_base (1)..(1): 2'-O-methylguanosine
  modified_base (2)..(2): 2'-O-methylguanosine
  modified_base (3)..(3): 2'-O-methylguanosine
  modified_base (4)..(4): N6-methy-2'-O-methyladenosine
  modified_base (5)..(5): 2'-O-methylguanosine
  modified_base (6)..(6): N6-methy-2'-O-methyladenosine
  modified_base (7)..(7): N6-methy-2'-O-methyladenosine
  modified_base (9)..(9): N6-methy-2'-O-methyladenosine
  modified_base (11)..(11): N6-methy-2'-O-methyladenosine
  modified_base (12)..(12): N6-methy-2'-O-methyladenosine
  modified_base (16)..(16): N6-methy-2'-O-methyladenosine
  modified_base (31)..(31): N6-methy-2'-O-methyladenosine
  modified_base (35)..(35): N6-methy-2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 243 - RNA, 80 nt, Artificial Sequence; identical to SEQ ID NO: 2
  E59-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): N6-methy-2'-O-methyladenosine
  modified_base (5)..(5): 2'-O-methylguanosine
  modified_base (6)..(6): N6-methy-2'-O-methyladenosine
  modified_base (7)..(7): N6-methy-2'-O-methyladenosine
  modified_base (9)..(9): N6-methy-2'-O-methyladenosine
  modified_base (11)..(11): N6-methy-2'-O-methyladenosine
  modified_base (12)..(12): N6-methy-2'-O-methyladenosine
  modified_base (16)..(16): N6-methy-2'-O-methyladenosine
  modified_base (31)..(31): N6-methy-2'-O-methyladenosine
  modified_base (35)..(35): N6-methy-2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 244 - RNA, 65 nt, Artificial Sequence; identical to SEQ ID NO: 3
  E59-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 245 - RNA, 145 nt, Artificial Sequence; identical to SEQ ID NO: 1
  E60
  modified_base (1)..(1): 2'-O-methylguanosine
  modified_base (2)..(2): 2'-O-methylguanosine
  modified_base (3)..(3): 2'-O-methylguanosine
  modified_base (4)..(4): N6-methy-2'-deoxy-2'-fluoroadenosine
  modified_base (5)..(5): 2'-O-methylguanosine
  modified_base (6)..(6): N6-methy-2'-deoxy-2'-fluoroadenosine
  modified_base (7)..(7): N6-methy-2'-deoxy-2'-fluoroadenosine
  modified_base (9)..(9): N6-methy-2'-deoxy-2'-fluoroadenosine
  modified_base (11)..(11): N6-methy-2'-deoxy-2'-fluoroadenosine
  modified_base (12)..(12): N6-methy-2'-deoxy-2'-fluoroadenosine
  modified_base (16)..(16): N6-methy-2'-deoxy-2'-fluoroadenosine
  modified_base (31)..(31): N6-methy-2'-deoxy-2'-fluoroadenosine
  modified_base (35)..(35): N6-methy-2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 246 - RNA, 80 nt, Artificial Sequence; identical to SEQ ID NO: 2
  E60-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): N6-methy-2'-deoxy-2'-fluoroadenosine
  modified_base (5)..(5): 2'-O-methylguanosine
  modified_base (6)..(6): N6-methy-2'-deoxy-2'-fluoroadenosine
  modified_base (7)..(7): N6-methy-2'-deoxy-2'-fluoroadenosine
  modified_base (9)..(9): N6-methy-2'-deoxy-2'-fluoroadenosine
  modified_base (11)..(11): N6-methy-2'-deoxy-2'-fluoroadenosine
  modified_base (12)..(12): N6-methy-2'-deoxy-2'-fluoroadenosine
  modified_base (16)..(16): N6-methy-2'-deoxy-2'-fluoroadenosine
  modified_base (31)..(31): N6-methy-2'-deoxy-2'-fluoroadenosine
  modified_base (35)..(35): N6-methy-2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 247 - RNA, 65 nt, Artificial Sequence; identical to SEQ ID NO: 3
  E60-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 248 - RNA, 148 nt, Artificial Sequence
  E61
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluoroguanosine
  modified_base (107)..(107): 2'-deoxy-2'-fluorouridine
  modified_base (110)..(110): 2'-deoxy-2'-fluoroadenosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroguanosine
  modified_base (125)..(125): 2'-deoxy-2'-fluoroadenosine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorocytidine
  modified_base (146)..(146): 2'-O-methyluridine
  modified_base (147)..(147): 2'-O-methylguanosine
  modified_base (148)..(148): 2'-O-methyladenosine
gggagaauacaagcuacuuguucuuuuugcagccaccauggacuacaaggacgacgacgacaagaucaucgacuauaaagacgacgacgauaaagguggcguggacuauaaggacgacgacgacaaacaccaccaccaccaccacuga

SEQ ID NO: 249 - RNA, 80 nt, Artificial Sequence; identical to SEQ ID NO: 2
  E61-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 250 - RNA, 68 nt, Artificial Sequence
  E61-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluoroguanosine
  modified_base (27)..(27): 2'-deoxy-2'-fluorouridine
  modified_base (30)..(30): 2'-deoxy-2'-fluoroadenosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-O-methyluridine
  modified_base (67)..(67): 2'-O-methylguanosine
  modified_base (68)..(68): 2'-O-methyladenosine
acgacgacgauaaagguggcguggacuauaaggacgacgacgacaaacaccaccaccaccaccacuga

SEQ ID NO: 251 - RNA, 148 nt, Artificial Sequence; identical to SEQ ID NO: 248
  E62
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (146)..(146): 2'-O-methyluridine
  modified_base (147)..(147): 2'-O-methylguanosine
  modified_base (148)..(148): 2'-O-methyladenosine

SEQ ID NO: 252 - RNA, 80 nt, Artificial Sequence; identical to SEQ ID NO: 2
  E62-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 253 - RNA, 68 nt, Artificial Sequence; identical to SEQ ID NO: 250
  E62-2
  misc_feature (1)..(1): 5'-phosphorylated
  modified_base (66)..(66): 2'-O-methyluridine
  modified_base (67)..(67): 2'-O-methylguanosine
  modified_base (68)..(68): 2'-O-methyladenosine

SEQ ID NO: 254 - RNA, 148 nt, Artificial Sequence
  E63
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluorocytidine
  modified_base (104)..(104): 2'-deoxy-2'-fluoroguanosine
  modified_base (107)..(107): 2'-deoxy-2'-fluorouridine
  modified_base (110)..(110): 2'-deoxy-2'-fluoroadenosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroguanosine
  modified_base (125)..(125): 2'-deoxy-2'-fluoroadenosine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorocytidine
  modified_base (146)..(146): 2'-O-methyluridine
  modified_base (147)..(147): 2'-O-methylguanosine
  modified_base (148)..(148): 2'-O-methyladenosine
gggagaauacaagcuacuuguucuuuuugcagccaccauggacuacaaggacgacgacgacaagaucaucgacuauaaagacgacgacgauaaagguggccccgacuauaaggacgacgacgacaaacaccaccaccaccaccacuga

SEQ ID NO: 255 - RNA, 80 nt, Artificial Sequence; identical to SEQ ID NO: 2
  E63-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 256 - RNA, 68 nt, Artificial Sequence
  E63-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluorocytidine
  modified_base (24)..(24): 2'-deoxy-2'-fluoroguanosine
  modified_base (27)..(27): 2'-deoxy-2'-fluorouridine
  modified_base (30)..(30): 2'-deoxy-2'-fluoroadenosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-O-methyluridine
  modified_base (67)..(67): 2'-O-methylguanosine
  modified_base (68)..(68): 2'-O-methyladenosine
acgacgacgauaaagguggccccgacuauaaggacgacgacgacaaacaccaccaccaccaccacuga

SEQ ID NO: 257 - RNA, 148 nt, Artificial Sequence; identical to SEQ ID NO: 254
  E64
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (146)..(146): 2'-O-methyluridine
  modified_base (147)..(147): 2'-O-methylguanosine
  modified_base (148)..(148): 2'-O-methyladenosine

SEQ ID NO: 258 - RNA, 80 nt, Artificial Sequence; identical to SEQ ID NO: 2
  E64-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 259 - RNA, 68 nt, Artificial Sequence; identical to SEQ ID NO: 256
  E64-2
  misc_feature (1)..(1): 5'-phosphorylated
  modified_base (66)..(66): 2'-O-methyluridine
  modified_base (67)..(67): 2'-O-methylguanosine
  modified_base (68)..(68): 2'-O-methyladenosine

SEQ ID NO: 260 - RNA, 148 nt, Artificial Sequence
  E65
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroadenosine
  modified_base (104)..(104): 2'-deoxy-2'-fluoroguanosine
  modified_base (107)..(107): 2'-deoxy-2'-fluorouridine
  modified_base (110)..(110): 2'-deoxy-2'-fluoroadenosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroguanosine
  modified_base (125)..(125): 2'-deoxy-2'-fluoroadenosine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorocytidine
  modified_base (146)..(146): 2'-O-methyluridine
  modified_base (147)..(147): 2'-O-methylguanosine
  modified_base (148)..(148): 2'-O-methyladenosine
gggagaauacaagcuacuuguucuuuuugcagccaccauggacuacaaggacgacgacgacaagaucaucgacuauaaagacgacgacgauaaagguggcaccgacuauaaggacgacgacgacaaacaccaccaccaccaccacuga

SEQ ID NO: 261 - RNA, 80 nt, Artificial Sequence; identical to SEQ ID NO: 2
  E65-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 262 - RNA, 68 nt, Artificial Sequence
  E65-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroadenosine
  modified_base (24)..(24): 2'-deoxy-2'-fluoroguanosine
  modified_base (27)..(27): 2'-deoxy-2'-fluorouridine
  modified_base (30)..(30): 2'-deoxy-2'-fluoroadenosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-O-methyluridine
  modified_base (67)..(67): 2'-O-methylguanosine
  modified_base (68)..(68): 2'-O-methyladenosine
acgacgacgauaaagguggcaccgacuauaaggacgacgacgacaaacaccaccaccaccaccacuga

SEQ ID NO: 263 - RNA, 148 nt, Artificial Sequence; identical to SEQ ID NO: 260
  E66
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (146)..(146): 2'-O-methyluridine
  modified_base (147)..(147): 2'-O-methylguanosine
  modified_base (148)..(148): 2'-O-methyladenosine

SEQ ID NO: 264 - RNA, 80 nt, Artificial Sequence; identical to SEQ ID NO: 2
  E66-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 265 - RNA, 68 nt, Artificial Sequence; identical to SEQ ID NO: 262
  E66-2
  misc_feature (1)..(1): 5'-phosphorylated
  modified_base (66)..(66): 2'-O-methyluridine
  modified_base (67)..(67): 2'-O-methylguanosine
  modified_base (68)..(68): 2'-O-methyladenosine

SEQ ID NO: 266 - RNA, 148 nt, Artificial Sequence
  E67
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluoroguanosine
  modified_base (107)..(107): 2'-deoxy-2'-fluorouridine
  modified_base (110)..(110): 2'-deoxy-2'-fluoroadenosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroguanosine
  modified_base (125)..(125): 2'-deoxy-2'-fluoroadenosine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorocytidine
  modified_base (146)..(146): 2'-O-methyluridine
  modified_base (147)..(147): 2'-O-methylguanosine
  modified_base (148)..(148): 2'-O-methyladenosine
gggagaauacaagcuacuuguucuuuuugcagccaccauggacuacaaggacgacgacgacaagaucaucgacuauaaagacgacgacgauaaagguggcgccgacuauaaggacgacgacgacaaacaccaccaccaccaccacuga

SEQ ID NO: 267 - RNA, 80 nt, Artificial Sequence; identical to SEQ ID NO: 2
  E67-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 268 - RNA, 68 nt, Artificial Sequence
  E67-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluoroguanosine
  modified_base (27)..(27): 2'-deoxy-2'-fluorouridine
  modified_base (30)..(30): 2'-deoxy-2'-fluoroadenosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-O-methyluridine
  modified_base (67)..(67): 2'-O-methylguanosine
  modified_base (68)..(68): 2'-O-methyladenosine
acgacgacgauaaagguggcgccgacuauaaggacgacgacgacaaacaccaccaccaccaccacuga

SEQ ID NO: 269 - RNA, 148 nt, Artificial Sequence; identical to SEQ ID NO: 266
  E68
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (146)..(146): 2'-O-methyluridine
  modified_base (147)..(147): 2'-O-methylguanosine
  modified_base (148)..(148): 2'-O-methyladenosine

SEQ ID NO: 270 - RNA, 80 nt, Artificial Sequence; identical to SEQ ID NO: 2
  E68-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 271 - RNA, 68 nt, Artificial Sequence; identical to SEQ ID NO: 268
  E68-2
  misc_feature (1)..(1): 5'-phosphorylated
  modified_base (66)..(66): 2'-O-methyluridine
  modified_base (67)..(67): 2'-O-methylguanosine
  modified_base (68)..(68): 2'-O-methyladenosine

SEQ ID NO: 272 - RNA, 148 nt, Artificial Sequence
  E69
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluorocytidine
  modified_base (104)..(104): 2'-deoxy-2'-fluoroguanosine
  modified_base (107)..(107): 2'-deoxy-2'-fluorouridine
  modified_base (110)..(110): 2'-deoxy-2'-fluoroadenosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroguanosine
  modified_base (125)..(125): 2'-deoxy-2'-fluoroadenosine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorocytidine
  modified_base (146)..(146): 2'-O-methyluridine
  modified_base (147)..(147): 2'-O-methylguanosine
  modified_base (148)..(148): 2'-O-methyladenosine
gggagaauacaagcuacuuguucuuuuugcagccaccauggacuacaaggacgacgacgacaagaucaucgacuauaaagacgacgacgauaaagguggccaggacuauaaggacgacgacgacaaacaccaccaccaccaccacuga

SEQ ID NO: 273 - RNA, 80 nt, Artificial Sequence; identical to SEQ ID NO: 2
  E69-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 274 - RNA, 68 nt, Artificial Sequence
  E69-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluorocytidine
  modified_base (24)..(24): 2'-deoxy-2'-fluoroguanosine
  modified_base (27)..(27): 2'-deoxy-2'-fluorouridine
  modified_base (30)..(30): 2'-deoxy-2'-fluoroadenosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-O-methyluridine
  modified_base (67)..(67): 2'-O-methylguanosine
  modified_base (68)..(68): 2'-O-methyladenosine
acgacgacgauaaagguggccaggacuauaaggacgacgacgacaaacaccaccaccaccaccacuga

SEQ ID NO: 275 - RNA, 148 nt, Artificial Sequence; identical to SEQ ID NO: 272
  E70
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (146)..(146): 2'-O-methyluridine
  modified_base (147)..(147): 2'-O-methylguanosine
  modified_base (148)..(148): 2'-O-methyladenosine

SEQ ID NO: 276 - RNA, 80 nt, Artificial Sequence; identical to SEQ ID NO: 2
  E70-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 277 - RNA, 68 nt, Artificial Sequence; identical to SEQ ID NO: 274
  E70-2
  misc_feature (1)..(1): 5'-phosphorylated
  modified_base (66)..(66): 2'-O-methyluridine
  modified_base (67)..(67): 2'-O-methylguanosine
  modified_base (68)..(68): 2'-O-methyladenosine

SEQ ID NO: 278 - RNA, 148 nt, Artificial Sequence
  E71
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluorouridine
  modified_base (104)..(104): 2'-deoxy-2'-fluoroguanosine
  modified_base (107)..(107): 2'-deoxy-2'-fluorouridine
  modified_base (110)..(110): 2'-deoxy-2'-fluoroadenosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroguanosine
  modified_base (125)..(125): 2'-deoxy-2'-fluoroadenosine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorocytidine
  modified_base (146)..(146): 2'-O-methyluridine
  modified_base (147)..(147): 2'-O-methylguanosine
  modified_base (148)..(148): 2'-O-methyladenosine
gggagaauacaagcuacuuguucuuuuugcagccaccauggacuacaaggacgacgacgacaagaucaucgacuauaaagacgacgacgauaaagguggcugcgacuauaaggacgacgacgacaaacaccaccaccaccaccacuga

SEQ ID NO: 279 - RNA, 80 nt, Artificial Sequence; identical to SEQ ID NO: 2
  E71-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 280 - RNA, 68 nt, Artificial Sequence
  E71-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluorouridine
  modified_base (24)..(24): 2'-deoxy-2'-fluoroguanosine
  modified_base (27)..(27): 2'-deoxy-2'-fluorouridine
  modified_base (30)..(30): 2'-deoxy-2'-fluoroadenosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-O-methyluridine
  modified_base (67)..(67): 2'-O-methylguanosine
  modified_base (68)..(68): 2'-O-methyladenosine
acgacgacgauaaagguggcugcgacuauaaggacgacgacgacaaacaccaccaccaccaccacuga

SEQ ID NO: 281 - RNA, 148 nt, Artificial Sequence; identical to SEQ ID NO: 278
  E72
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (146)..(146): 2'-O-methyluridine
  modified_base (147)..(147): 2'-O-methylguanosine
  modified_base (148)..(148): 2'-O-methyladenosine

SEQ ID NO: 282 - RNA, 80 nt, Artificial Sequence; identical to SEQ ID NO: 2
  E72-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 283 - RNA, 68 nt, Artificial Sequence; identical to SEQ ID NO: 280
  E72-2
  misc_feature (1)..(1): 5'-phosphorylated
  modified_base (66)..(66): 2'-O-methyluridine
  modified_base (67)..(67): 2'-O-methylguanosine
  modified_base (68)..(68): 2'-O-methyladenosine

SEQ ID NO: 284 - RNA, 148 nt, Artificial Sequence
  E73
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroadenosine
  modified_base (104)..(104): 2'-deoxy-2'-fluoroguanosine
  modified_base (107)..(107): 2'-deoxy-2'-fluorouridine
  modified_base (110)..(110): 2'-deoxy-2'-fluoroadenosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroguanosine
  modified_base (125)..(125): 2'-deoxy-2'-fluoroadenosine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorocytidine
  modified_base (146)..(146): 2'-O-methyluridine
  modified_base (147)..(147): 2'-O-methylguanosine
  modified_base (148)..(148): 2'-O-methyladenosine
gggagaauacaagcuacuuguucuuuuugcagccaccauggacuacaaggacgacgacgacaagaucaucgacuauaaagacgacgacgauaaagguggcagagacuauaaggacgacgacgacaaacaccaccaccaccaccacuga

SEQ ID NO: 285 - RNA, 80 nt, Artificial Sequence; identical to SEQ ID NO: 2
  E73-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 286 - RNA, 68 nt, Artificial Sequence
  E73-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroadenosine
  modified_base (24)..(24): 2'-deoxy-2'-fluoroguanosine
  modified_base (27)..(27): 2'-deoxy-2'-fluorouridine
  modified_base (30)..(30): 2'-deoxy-2'-fluoroadenosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-O-methyluridine
  modified_base (67)..(67): 2'-O-methylguanosine
  modified_base (68)..(68): 2'-O-methyladenosine
acgacgacgauaaagguggcagagacuauaaggacgacgacgacaaacaccaccaccaccaccacuga

SEQ ID NO: 287 - RNA, 148 nt, Artificial Sequence; identical to SEQ ID NO: 284
  E74
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (146)..(146): 2'-O-methyluridine
  modified_base (147)..(147): 2'-O-methylguanosine
  modified_base (148)..(148): 2'-O-methyladenosine

SEQ ID NO: 288 - RNA, 80 nt, Artificial Sequence; identical to SEQ ID NO: 2
  E74-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 289 - RNA, 68 nt, Artificial Sequence; identical to SEQ ID NO: 286
  E74-2
  misc_feature (1)..(1): 5'-phosphorylated
  modified_base (66)..(66): 2'-O-methyluridine
  modified_base (67)..(67): 2'-O-methylguanosine
  modified_base (68)..(68): 2'-O-methyladenosine

SEQ ID NO: 290 - RNA, 148 nt, Artificial Sequence
  E75
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluorouridine
  modified_base (104)..(104): 2'-deoxy-2'-fluoroguanosine
  modified_base (107)..(107): 2'-deoxy-2'-fluorouridine
  modified_base (110)..(110): 2'-deoxy-2'-fluoroadenosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroguanosine
  modified_base (125)..(125): 2'-deoxy-2'-fluoroadenosine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorocytidine
  modified_base (146)..(146): 2'-O-methyluridine
  modified_base (147)..(147): 2'-O-methylguanosine
  modified_base (148)..(148): 2'-O-methyladenosine
gggagaauacaagcuacuuguucuuuuugcagccaccauggacuacaaggacgacgacgacaagaucaucgacuauaaagacgacgacgauaaagguggcugggacuauaaggacgacgacgacaaacaccaccaccaccaccacuga

SEQ ID NO: 291 - RNA, 80 nt, Artificial Sequence; identical to SEQ ID NO: 2
  E75-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 292 - RNA, 68 nt, Artificial Sequence
  E75-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluorouridine
  modified_base (24)..(24): 2'-deoxy-2'-fluoroguanosine
  modified_base (27)..(27): 2'-deoxy-2'-fluorouridine
  modified_base (30)..(30): 2'-deoxy-2'-fluoroadenosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-O-methyluridine
  modified_base (67)..(67): 2'-O-methylguanosine
  modified_base (68)..(68): 2'-O-methyladenosine
acgacgacgauaaagguggcugggacuauaaggacgacgacgacaaacaccaccaccaccaccacuga

SEQ ID NO: 293 - RNA, 148 nt, Artificial Sequence; identical to SEQ ID NO: 290
  E76
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (146)..(146): 2'-O-methyluridine
  modified_base (147)..(147): 2'-O-methylguanosine
  modified_base (148)..(148): 2'-O-methyladenosine

SEQ ID NO: 294 - RNA, 80 nt, Artificial Sequence; identical to SEQ ID NO: 2
  E76-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 295 - RNA, 68 nt, Artificial Sequence; identical to SEQ ID NO: 292
  E76-2
  misc_feature (1)..(1): 5'-phosphorylated
  modified_base (66)..(66): 2'-O-methyluridine
  modified_base (67)..(67): 2'-O-methylguanosine
  modified_base (68)..(68): 2'-O-methyladenosine

SEQ ID NO: 296 - RNA, 148 nt, Artificial Sequence
  E77
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluoroguanosine
  modified_base (107)..(107): 2'-deoxy-2'-fluorouridine
  modified_base (110)..(110): 2'-deoxy-2'-fluoroadenosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroguanosine
  modified_base (125)..(125): 2'-deoxy-2'-fluoroadenosine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorocytidine
  modified_base (146)..(146): 2'-O-methyluridine
  modified_base (147)..(147): 2'-O-methylguanosine
  modified_base (148)..(148): 2'-O-methyladenosine
gggagaauacaagcuacuuguucuuuuugcagccaccauggacuacaaggacgacgacgacaagaucaucgacuauaaagacgacgacgauaaagguggcggcgacuauaaggacgacgacgacaaacaccaccaccaccaccacuga

SEQ ID NO: 297 - RNA, 80 nt, Artificial Sequence; identical to SEQ ID NO: 2
  E77-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 298 - RNA, 68 nt, Artificial Sequence
  E77-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluoroguanosine
  modified_base (27)..(27): 2'-deoxy-2'-fluorouridine
  modified_base (30)..(30): 2'-deoxy-2'-fluoroadenosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-O-methyluridine
  modified_base (67)..(67): 2'-O-methylguanosine
  modified_base (68)..(68): 2'-O-methyladenosine
acgacgacgauaaagguggcggcgacuauaaggacgacgacgacaaacaccaccaccaccaccacuga

SEQ ID NO: 299 - RNA, 148 nt, Artificial Sequence; identical to SEQ ID NO: 296
  E78
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (146)..(146): 2'-O-methyluridine
  modified_base (147)..(147): 2'-O-methylguanosine
  modified_base (148)..(148): 2'-O-methyladenosine

SEQ ID NO: 300 - RNA, 80 nt, Artificial Sequence; identical to SEQ ID NO: 2
  E78-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 301 - RNA, 68 nt, Artificial Sequence; identical to SEQ ID NO: 298
  E78-2
  misc_feature (1)..(1): 5'-phosphorylated
  modified_base (66)..(66): 2'-O-methyluridine
  modified_base (67)..(67): 2'-O-methylguanosine
  modified_base (68)..(68): 2'-O-methyladenosine

SEQ ID NO: 302 - RNA, 91 nt, Artificial Sequence
  E79
gggagaauacaagcuacuuguucuuuuugcagccaccauggacuauaaggacgacgacgacaaagguggccaccaccaccaccaccacuga

SEQ ID NO: 303 - RNA, 91 nt, Artificial Sequence; identical to SEQ ID NO: 302
  E80
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (89)..(89): 2'-O-methoxyethyluridine
  modified_base (90)..(90): 2'-O-methoxyethylguanosine
  modified_base (91)..(91): 2'-O-methoxyethyladenosine

SEQ ID NO: 304 - RNA, 91 nt, Artificial Sequence; identical to SEQ ID NO: 302
  E81
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  misc_feature (3)..(4): 5'-phosphonothioate
  modified_base (3)..(3): 2'-deoxy-2'-fluoroguanosine
  misc_feature (4)..(5): 5'-phosphonothioate
  modified_base (4)..(4): 2'-O-methyladenosine
  modified_base (5)..(5): 2'-deoxy-2'-fluoroguanosine
  modified_base (6)..(6): 2'-O-methyladenosine
  misc_feature (89)..(90): 5'-phosphonothioate
  modified_base (89)..(89): 2'-O-methyluridine
  misc_feature (90)..(91): 5'-phosphonothioate
  modified_base (90)..(90): 2'-deoxy-2'-fluoroguanosine
  modified_base (91)..(91): 2'-O-methyladenosine

SEQ ID NO: 305 - RNA, 88 nt, Artificial Sequence
  E82
gggagccaccauggacuauaaagacgacgacgauaaagguggcgacuauaaggacgacgacgacaaacaccaccaccaccaccacuga

SEQ ID NO: 306 - RNA, 64 nt, Artificial Sequence
  E83
gggagccaccauggacuauaaggacgacgacgacaaagguggccaccaccaccaccaccacuga

SEQ ID NO: 307 - RNA, 88 nt, Artificial Sequence; identical to SEQ ID NO: 305
  E84
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (86)..(86): 2'-O-methoxyethyluridine
  modified_base (87)..(87): 2'-O-methoxyethylguanosine
  modified_base (88)..(88): 2'-O-methoxyethyladenosine

SEQ ID NO: 308 - RNA, 88 nt, Artificial Sequence; identical to SEQ ID NO: 305
  E85
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  modified_base (3)..(3): 2'-deoxy-2'-fluoroguanosine
  misc_feature (86)..(87): 5'-phosphonothioate
  modified_base (86)..(86): 2'-O-methyluridine
  misc_feature (87)..(88): 5'-phosphonothioate
  modified_base (87)..(87): 2'-deoxy-2'-fluoroguanosine
  modified_base (88)..(88): 2'-O-methyladenosine

SEQ ID NO: 309 - RNA, 145 nt, Artificial Sequence; identical to SEQ ID NO: 1
  E86
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (143)..(143): 2'-O-methoxyethyluridine
  modified_base (144)..(144): 2'-O-methoxyethylguanosine
  modified_base (145)..(145): 2'-O-methoxyethyladenosine

SEQ ID NO: 310 - RNA, 80 nt, Artificial Sequence; identical to SEQ ID NO: 2
  E86-1
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine

SEQ ID NO: 311 - RNA, 65 nt, Artificial Sequence; identical to SEQ ID NO: 3
  E86-2
  misc_feature (1)..(1): 5'-phosphorylated
  modified_base (63)..(63): 2'-O-methoxyethyluridine
  modified_base (64)..(64): 2'-O-methoxyethylguanosine
  modified_base (65)..(65): 2'-O-methoxyethyladenosine

SEQ ID NO: 312 - RNA, 145 nt, Artificial Sequence; identical to SEQ ID NO: 1
  E87
  modified_base (1)..(1): 2'-deoxy-2'-fluoroguanosine
  modified_base (2)..(2): 2'-deoxy-2'-fluoroguanosine
  modified_base (3)..(3): 2'-deoxy-2'-fluoroguanosine
  modified_base (4)..(4): 2'-deoxy-2'-fluoroadenosine
  modified_base (5)..(5): 2'-deoxy-2'-fluoroguanosine
  modified_base (6)..(6): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-deoxy-2'-fluorouridine
  modified_base (144)..(144): 2'-deoxy-2'-fluoroguanosine
  modified_base (145)..(145): 2'-deoxy-2'-fluoroadenosine

SEQ ID NO: 313 - RNA, 80 nt, Artificial Sequence; identical to SEQ ID NO: 2
  E87-1
  modified_base (1)..(1): 2'-deoxy-2'-fluoroguanosine
  modified_base (2)..(2): 2'-deoxy-2'-fluoroguanosine
  modified_base (3)..(3): 2'-deoxy-2'-fluoroguanosine
  modified_base (4)..(4): 2'-deoxy-2'-fluoroadenosine
  modified_base (5)..(5): 2'-deoxy-2'-fluoroguanosine
  modified_base (6)..(6): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 314 - RNA, 65 nt, Artificial Sequence; identical to SEQ ID NO: 3
  E87-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine
  modified_base (64)..(64): 2'-deoxy-2'-fluoroguanosine
  modified_base (65)..(65): 2'-deoxy-2'-fluoroadenosine

SEQ ID NO: 315 - RNA, 145 nt, Artificial Sequence; identical to SEQ ID NO: 1
  E88
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (49)..(49): 2'-O-methylguanosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (64)..(64): 2'-O-methylguanosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (109)..(109): 2'-O-methylguanosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 316 - RNA, 80 nt, Artificial Sequence; identical to SEQ ID NO: 2
  E88-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (49)..(49): 2'-O-methylguanosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (64)..(64): 2'-O-methylguanosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 317 - RNA, 65 nt, Artificial Sequence; identical to SEQ ID NO: 3
  E88-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (29)..(29): 2'-O-methylguanosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 318 - RNA, 145 nt, Artificial Sequence; identical to SEQ ID NO: 1
  E89
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (47)..(47): 2'-deoxy-2'-fluoroadenosine
  modified_base (49)..(49): 2'-O-methylguanosine
  modified_base (62)..(62): 2'-deoxy-2'-fluoroadenosine
  modified_base (64)..(64): 2'-O-methylguanosine
  modified_base (107)..(107): 2'-deoxy-2'-fluoroadenosine
  modified_base (109)..(109): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 319 - RNA, 80 nt, Artificial Sequence; identical to SEQ ID NO: 2
  E89-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (47)..(47): 2'-deoxy-2'-fluoroadenosine
  modified_base (49)..(49): 2'-O-methylguanosine
  modified_base (62)..(62): 2'-deoxy-2'-fluoroadenosine
  modified_base (64)..(64): 2'-O-methylguanosine

SEQ ID NO: 320 - RNA, 65 nt, Artificial Sequence; identical to SEQ ID NO: 3
  E89-2
  misc_feature (1)..(1): 5'-phosphorylated
  modified_base (27)..(27): 2'-deoxy-2'-fluoroadenosine
  modified_base (29)..(29): 2'-O-methylguanosine
  modified_base (63)..(63): 2'-O-methyluridine
  modified_base (64)..(64): 2'-O-methylguanosine
  modified_base (65)..(65): 2'-O-methyladenosine

SEQ ID NO: 321 - RNA, 145 nt, Artificial Sequence; identical to SEQ ID NO: 1
  E90
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (47)..(47): 2'-deoxy-2'-fluoroadenosine
  modified_base (62)..(62): 2'-deoxy-2'-fluoroadenosine
  modified_base (107)..(107): 2'-deoxy-2'-fluoroadenosine
  modified_base (143)..(143): 2'-O-methyluridine
  modified_base (144)..(144): 2'-O-methylguanosine
  modified_base (145)..(145): 2'-O-methyladenosine

SEQ ID NO: 322 - RNA, 80 nt, Artificial Sequence; identical to SEQ ID NO: 2
  E90-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (47)..(47): 2'-deoxy-2'-fluoroadenosine
  modified_base (62)..(62): 2'-deoxy-2'-fluoroadenosine

SEQ ID NO: 323 - RNA, 65 nt, Artificial Sequence; identical to SEQ ID NO: 3
  E90-2
  misc_feature (1)..(1): 5'-phosphorylated
  modified_base (27)..(27): 2'-deoxy-2'-fluoroadenosine
  modified_base (63)..(63): 2'-O-methyluridine
  modified_base (64)..(64): 2'-O-methylguanosine
  modified_base (65)..(65): 2'-O-methyladenosine

SEQ ID NO: 324 - RNA, 145 nt, Artificial Sequence; identical to SEQ ID NO: 1
  E91
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (43)..(43): 2'-O-methylcytidine
  modified_base (59)..(59): 2'-deoxy-2'-fluoroguanosine
  modified_base (61)..(61): 2'-O-methylcytidine
  modified_base (71)..(71): 2'-deoxy-2'-fluoroguanosine
  modified_base (73)..(73): 2'-O-methylcytidine
  modified_base (86)..(86): 2'-deoxy-2'-fluoroguanosine
  modified_base (88)..(88): 2'-O-methylcytidine
  modified_base (101)..(101): 2'-deoxy-2'-fluoroguanosine
  modified_base (103)..(103): 2'-O-methylcytidine
  modified_base (119)..(119): 2'-deoxy-2'-fluoroguanosine
  modified_base (121)..(121): 2'-O-methylcytidine
  modified_base (143)..(143): 2'-O-methyluridine
  modified_base (144)..(144): 2'-O-methylguanosine
  modified_base (145)..(145): 2'-O-methyladenosine

SEQ ID NO: 325 - RNA, 80 nt, Artificial Sequence; identical to SEQ ID NO: 2
  E91-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (43)..(43): 2'-O-methylcytidine
  modified_base (59)..(59): 2'-deoxy-2'-fluoroguanosine
  modified_base (61)..(61): 2'-O-methylcytidine
  modified_base (71)..(71): 2'-deoxy-2'-fluoroguanosine
  modified_base (73)..(73): 2'-O-methylcytidine

SEQ ID NO: 326 - RNA, 65 nt, Artificial Sequence; identical to SEQ ID NO: 3
  E91-2
  misc_feature (1)..(1): 5'-phosphorylated
  modified_base (6)..(6): 2'-deoxy-2'-fluoroguanosine
  modified_base (8)..(8): 2'-O-methylcytidine
  modified_base (21)..(21): 2'-deoxy-2'-fluoroguanosine
  modified_base (23)..(23): 2'-O-methylcytidine
  modified_base (39)..(39): 2'-deoxy-2'-fluoroguanosine
  modified_base (41)..(41): 2'-O-methylcytidine
  modified_base (63)..(63): 2'-O-methyluridine
  modified_base (64)..(64): 2'-O-methylguanosine
  modified_base (65)..(65): 2'-O-methyladenosine

SEQ ID NO: 327 - RNA, 145 nt, Artificial Sequence; identical to SEQ ID NO: 1
  E92
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (74)..(74): 2'-deoxy-2'-fluorouridine
  modified_base (76)..(76): 2'-O-methyluridine
  modified_base (89)..(89): 2'-deoxy-2'-fluoroguanosine
  modified_base (91)..(91): 2'-O-methyluridine
  modified_base (95)..(95): 2'-deoxy-2'-fluoroguanosine
  modified_base (97)..(97): 2'-O-methyluridine
  modified_base (104)..(104): 2'-deoxy-2'-fluorouridine
  modified_base (106)..(106): 2'-O-methyluridine
  modified_base (143)..(143): 2'-O-methyluridine
  modified_base (144)..(144): 2'-O-methylguanosine
  modified_base (145)..(145): 2'-O-methyladenosine

SEQ ID NO: 328 - RNA, 80 nt, Artificial Sequence; identical to SEQ ID NO: 2
  E92-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (74)..(74): 2'-deoxy-2'-fluorouridine
  modified_base (76)..(76): 2'-O-methyluridine

SEQ ID NO: 329 - RNA, 65 nt, Artificial Sequence; identical to SEQ ID NO: 3
  E92-2
  misc_feature (1)..(1): 5'-phosphorylated
  modified_base (9)..(9): 2'-deoxy-2'-fluoroguanosine
  modified_base (11)..(11): 2'-O-methyluridine
  modified_base (15)..(15): 2'-deoxy-2'-fluoroguanosine
  modified_base (17)..(17): 2'-O-methyluridine
  modified_base (24)..(24): 2'-deoxy-2'-fluorouridine
  modified_base (26)..(26): 2'-O-methyluridine
  modified_base (63)..(63): 2'-O-methyluridine
  modified_base (64)..(64): 2'-O-methylguanosine
  modified_base (65)..(65): 2'-O-methyladenosine

SEQ ID NO: 330 - RNA, 145 nt, Artificial Sequence; identical to SEQ ID NO: 1
  E93
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (74)..(74): 2'-deoxy-2'-fluorouridine
  modified_base (76)..(76): 2'-O-methyluridine
  modified_base (95)..(95): 2'-deoxy-2'-fluoroguanosine
  modified_base (97)..(97): 2'-O-methyluridine
  modified_base (104)..(104): 2'-deoxy-2'-fluorouridine
  modified_base (106)..(106): 2'-O-methyluridine
  modified_base (143)..(143): 2'-O-methyluridine
  modified_base (144)..(144): 2'-O-methylguanosine
  modified_base (145)..(145): 2'-O-methyladenosine

SEQ ID NO: 331 - RNA, 80 nt, Artificial Sequence; identical to SEQ ID NO: 2
  E93-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (74)..(74): 2'-deoxy-2'-fluorouridine
  modified_base (76)..(76): 2'-O-methyluridine

SEQ ID NO: 332 - RNA, 65 nt, Artificial Sequence; identical to SEQ ID NO: 3
  E93-2
  misc_feature (1)..(1): 5'-phosphorylated
  modified_base (15)..(15): 2'-deoxy-2'-fluoroguanosine
  modified_base (17)..(17): 2'-O-methyluridine
  modified_base (24)..(24): 2'-deoxy-2'-fluorouridine
  modified_base (26)..(26): 2'-O-methyluridine
  modified_base (63)..(63): 2'-O-methyluridine
  modified_base (64)..(64): 2'-O-methylguanosine
  modified_base (65)..(65): 2'-O-methyladenosine

SEQ ID NO: 333 - RNA, 145 nt, Artificial Sequence; identical to SEQ ID NO: 1
  E94
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-O-methylguanosine
  modified_base (59)..(59): 2'-O-methylguanosine
  modified_base (71)..(71): 2'-O-methylguanosine
  modified_base (86)..(86): 2'-O-methylguanosine
  modified_base (101)..(101): 2'-O-methylguanosine
  modified_base (119)..(119): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 334 - RNA, 80 nt, Artificial Sequence; identical to SEQ ID NO: 2
  E94-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-O-methylguanosine
  modified_base (59)..(59): 2'-O-methylguanosine
  modified_base (71)..(71): 2'-O-methylguanosine

SEQ ID NO: 335 - RNA, 65 nt, Artificial Sequence; identical to SEQ ID NO: 3
  E94-2
  misc_feature (1)..(1): 5'-phosphorylated
  modified_base (6)..(6): 2'-O-methylguanosine
  modified_base (21)..(21): 2'-O-methylguanosine
  modified_base (39)..(39): 2'-O-methylguanosine
  modified_base (63)..(63): 2'-O-methyluridine
  modified_base (64)..(64): 2'-O-methylguanosine
  modified_base (65)..(65): 2'-O-methyladenosine

SEQ ID NO: 336 - RNA, 145 nt, Artificial Sequence; identical to SEQ ID NO: 1
  E95
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (50)..(50): 2'-O-methylguanosine
  modified_base (53)..(53): 2'-O-methylguanosine
  modified_base (56)..(56): 2'-O-methylguanosine
  modified_base (110)..(110): 2'-O-methylguanosine
  modified_base (113)..(113): 2'-O-methylguanosine
  modified_base (116)..(116): 2'-O-methylguanosine
  modified_base (143)..(143): 2'-O-methyluridine
  modified_base (144)..(144): 2'-O-methylguanosine
  modified_base (145)..(145): 2'-O-methyladenosine

SEQ ID NO: 337 - RNA, 80 nt, Artificial Sequence; identical to SEQ ID NO: 2
  E95-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (50)..(50): 2'-O-methylguanosine
  modified_base (53)..(53): 2'-O-methylguanosine
  modified_base (56)..(56): 2'-O-methylguanosine

SEQ ID NO: 338 - RNA, 65 nt, Artificial Sequence; identical to SEQ ID NO: 3
  E95-2
  misc_feature (1)..(1): 5'-phosphorylated
  modified_base (30)..(30): 2'-O-methylguanosine
  modified_base (33)..(33): 2'-O-methylguanosine
  modified_base (36)..(36): 2'-O-methylguanosine
  modified_base (63)..(63): 2'-O-methyluridine
  modified_base (64)..(64): 2'-O-methylguanosine
  modified_base (65)..(65): 2'-O-methyladenosine

SEQ ID NO: 339 - RNA, 145 nt, Artificial Sequence; identical to SEQ ID NO: 1
  E96
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  misc_feature (41)..(41): LNA
  misc_feature (59)..(59): LNA
  misc_feature (71)..(71): LNA
  misc_feature (86)..(86): LNA
  misc_feature (101)..(101): LNA
  misc_feature (119)..(119): LNA
  modified_base (143)..(143): 2'-O-methyluridine
  modified_base (144)..(144): 2'-O-methylguanosine
  modified_base (145)..(145): 2'-O-methyladenosine

SEQ ID NO: 340 - RNA, 80 nt, Artificial Sequence; identical to SEQ ID NO: 2
  E96-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  misc_feature (41)..(41): LNA
  misc_feature (59)..(59): LNA
  misc_feature (71)..(71): LNA

SEQ ID NO: 341 - RNA, 65 nt, Artificial Sequence; identical to SEQ ID NO: 3
  E96-2
  misc_feature (1)..(1): 5'-phosphorylated
  misc_feature (6)..(6): LNA
  misc_feature (21)..(21): LNA
  misc_feature (39)..(39): LNA
  modified_base (63)..(63): 2'-O-methyluridine
  modified_base (64)..(64): 2'-O-methylguanosine
  modified_base (65)..(65): 2'-O-methyladenosine

SEQ ID NO: 342 - RNA, 145 nt, Artificial Sequence; identical to SEQ ID NO: 1
  E97
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine
  modified_base (143)..(143): 2'-O-methyluridine
  modified_base (144)..(144): 2'-deoxy-2'-fluoroguanosine
  modified_base (145)..(145): 2'-O-methyladenosine

SEQ ID NO: 343 - RNA, 80 nt, Artificial Sequence; identical to SEQ ID NO: 2
  E97-1
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine

SEQ ID NO: 344 - RNA, 65 nt, Artificial Sequence; identical to SEQ ID NO: 3
  E97-2
  misc_feature (1)..(1): 5'-phosphorylated
  modified_base (63)..(63): 2'-O-methyluridine
  modified_base (64)..(64): 2'-deoxy-2'-fluoroguanosine
  modified_base (65)..(65): 2'-O-methyladenosine

SEQ ID NO: 345 - RNA, 145 nt, Artificial Sequence; identical to SEQ ID NO: 1
  E98
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  misc_feature (3)..(4): 5'-phosphonothioate
  modified_base (3)..(3): 2'-deoxy-2'-fluoroguanosine
  misc_feature (4)..(5): 5'-phosphonothioate
  modified_base (4)..(4): 2'-O-methyladenosine
  modified_base (5)..(5): 2'-deoxy-2'-fluoroguanosine
  modified_base (6)..(6): 2'-O-methyladenosine
  misc_feature (143)..(144): 5'-phosphonothioate
  modified_base (143)..(143): 2'-O-methyluridine
  misc_feature (144)..(145): 5'-phosphonothioate
  modified_base (144)..(144): 2'-deoxy-2'-fluoroguanosine
  modified_base (145)..(145): 2'-O-methyladenosine

SEQ ID NO: 346 - RNA, 80 nt, Artificial Sequence; identical to SEQ ID NO: 2
  E98-1
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  misc_feature (3)..(4): 5'-phosphonothioate
  modified_base (3)..(3): 2'-deoxy-2'-fluoroguanosine
  misc_feature (4)..(5): 5'-phosphonothioate
  modified_base (4)..(4): 2'-O-methyladenosine
  modified_base (5)..(5): 2'-deoxy-2'-fluoroguanosine
  modified_base (6)..(6): 2'-O-methyladenosine

SEQ ID NO: 347 - RNA, 65 nt, Artificial Sequence; identical to SEQ ID NO: 3
  E98-2
  misc_feature (1)..(1): 5'-phosphorylated
  misc_feature (63)..(64): 5'-phosphonothioate
  modified_base (63)..(63): 2'-O-methyluridine
  misc_feature (64)..(65): 5'-phosphonothioate
  modified_base (64)..(64): 2'-deoxy-2'-fluoroguanosine
  modified_base (65)..(65): 2'-O-methyladenosine

SEQ ID NO: 348 - RNA, 145 nt, Artificial Sequence; identical to SEQ ID NO: 1
  E99
  misc_feature (1)..(1): BNA
  misc_feature (2)..(2): BNA
  misc_feature (3)..(3): BNA
  misc_feature (4)..(4): BNA
  misc_feature (5)..(5): BNA
  misc_feature (6)..(6): BNA
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  misc_feature (143)..(143): BNA
  misc_feature (144)..(144): BNA
  misc_feature (145)..(145): BNA

SEQ ID NO: 349 - RNA, 80 nt, Artificial Sequence; identical to SEQ ID NO: 2
  E99-1
  misc_feature (1)..(1): BNA
  misc_feature (2)..(2): BNA
  misc_feature (3)..(3): BNA
  misc_feature (4)..(4): BNA
  misc_feature (5)..(5): BNA
  misc_feature (6)..(6): BNA
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 350 - RNA, 65 nt, Artificial Sequence; identical to SEQ ID NO: 3
  E99-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  misc_feature (63)..(63): BNA
  misc_feature (64)..(64): BNA
  misc_feature (65)..(65): BNA

SEQ ID NO: 351 - RNA, 145 nt, Artificial Sequence; identical to SEQ ID NO: 1
  E100
  misc_feature (1)..(2): 5'-phosphonothioate
  modified_base (1)..(1): 2'-O-methylguanosine
  misc_feature (2)..(3): 5'-phosphonothioate
  modified_base (2)..(2): 2'-O-methylguanosine
  misc_feature (3)..(4): 5'-phosphonothioate
  modified_base (3)..(3): 2'-O-methylguanosine
  misc_feature (4)..(5): 5'-phosphonothioate
  modified_base (4)..(4): 2'-O-methyladenosine
  misc_feature (5)..(6): 5'-phosphonothioate
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  misc_feature (143)..(144): 5'-phosphonothioate
  modified_base (143)..(143): 2'-O-methyluridine
  misc_feature (144)..(145): 5'-phosphonothioate
  modified_base (144)..(144): 2'-O-methylguanosine
  modified_base (145)..(145): 2'-O-methyladenosine

SEQ ID NO: 352 - RNA, 80 nt, Artificial Sequence; identical to SEQ ID NO: 2
  E100-1
  misc_feature (1)..(2): 5'-phosphonothioate
  modified_base (1)..(1): 2'-O-methylguanosine
  misc_feature (2)..(3): 5'-phosphonothioate
  modified_base (2)..(2): 2'-O-methylguanosine
  misc_feature (3)..(4): 5'-phosphonothioate
  modified_base (3)..(3): 2'-O-methylguanosine
  misc_feature (4)..(5): 5'-phosphonothioate
  modified_base (4)..(4): 2'-O-methyladenosine
  misc_feature (5)..(6): 5'-phosphonothioate
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 353 - RNA, 65 nt, Artificial Sequence; identical to SEQ ID NO: 3
  E100-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  misc_feature (63)..(64): 5'-phosphonothioate
  modified_base (63)..(63): 2'-O-methyluridine
  misc_feature (64)..(65): 5'-phosphonothioate
  modified_base (64)..(64): 2'-O-methylguanosine
  modified_base (65)..(65): 2'-O-methyladenosine

SEQ ID NO: 354 - RNA, 265 nt, Artificial Sequence
  E101
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine
  modified_base (101)..(101): 2'-deoxy-2'-fluoroadenosine
  modified_base (104)..(104): 2'-deoxy-2'-fluoroadenosine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluorouridine
  modified_base (116)..(116): 2'-deoxy-2'-fluoroguanosine
  modified_base (119)..(119): 2'-deoxy-2'-fluorouridine
  modified_base (122)..(122): 2'-deoxy-2'-fluorocytidine
  modified_base (125)..(125): 2'-deoxy-2'-fluorocytidine
  modified_base (128)..(128): 2'-deoxy-2'-fluorouridine
  modified_base (131)..(131): 2'-deoxy-2'-fluorocytidine
  modified_base (134)..(134): 2'-deoxy-2'-fluoroguanosine
  modified_base (137)..(137): 2'-deoxy-2'-fluoroguanosine
  modified_base (140)..(140): 2'-deoxy-2'-fluorouridine
  modified_base (143)..(143): 2'-deoxy-2'-fluorouridine
  modified_base (146)..(146): 2'-deoxy-2'-fluorocytidine
  modified_base (149)..(149): 2'-deoxy-2'-fluorocytidine
  modified_base (152)..(152): 2'-deoxy-2'-fluoroguanosine
  modified_base (155)..(155): 2'-deoxy-2'-fluoroguanosine
  modified_base (158)..(158): 2'-deoxy-2'-fluoroguanosine
  modified_base (161)..(161): 2'-deoxy-2'-fluorouridine
  modified_base (164)..(164): 2'-deoxy-2'-fluoroadenosine
  modified_base (167)..(167): 2'-deoxy-2'-fluorouridine
gggagccaccauggacuacaaggacgacgacgacaagaucaucgacuauaaagacgacgacgauaaagguggcgacuauaaggacgacgacgacaaagccauuaauagugacucugaguguccccugucccacgacggguacugccuccacgacggugugugcauguauauugaagcauuggacaaguacgccugcaacuguguuguuggcuacaucggggagcgcugucaguaccgagaccugaaguggugggaacugcgcuga

SEQ ID NO: 355 - RNA, 94 nt, Artificial Sequence; identical to SEQ ID NO: 80
  E101-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine

SEQ ID NO: 356 - RNA, 85 nt, Artificial Sequence; identical to SEQ ID NO: 81
  E101-2
  misc_feature (1)..(1): 5'-phosphorylated
  modified_base (7)..(7): 2'-deoxy-2'-fluoroadenosine
  modified_base (10)..(10): 2'-deoxy-2'-fluoroadenosine
  modified_base (13)..(13): 2'-deoxy-2'-fluoroadenosine
  modified_base (16)..(16): 2'-deoxy-2'-fluoroguanosine
  modified_base (19)..(19): 2'-deoxy-2'-fluorouridine
  modified_base (22)..(22): 2'-deoxy-2'-fluoroguanosine
  modified_base (25)..(25): 2'-deoxy-2'-fluorouridine
  modified_base (28)..(28): 2'-deoxy-2'-fluorocytidine
  modified_base (31)..(31): 2'-deoxy-2'-fluorocytidine
  modified_base (34)..(34): 2'-deoxy-2'-fluorouridine
  modified_base (37)..(37): 2'-deoxy-2'-fluorocytidine
  modified_base (40)..(40): 2'-deoxy-2'-fluoroguanosine
  modified_base (43)..(43): 2'-deoxy-2'-fluoroguanosine
  modified_base (46)..(46): 2'-deoxy-2'-fluorouridine
  modified_base (49)..(49): 2'-deoxy-2'-fluorouridine
  modified_base (52)..(52): 2'-deoxy-2'-fluorocytidine
  modified_base (55)..(55): 2'-deoxy-2'-fluorocytidine
  modified_base (58)..(58): 2'-deoxy-2'-fluoroguanosine
  modified_base (61)..(61): 2'-deoxy-2'-fluoroguanosine
  modified_base (64)..(64): 2'-deoxy-2'-fluoroguanosine
  modified_base (67)..(67): 2'-deoxy-2'-fluorouridine
  modified_base (70)..(70): 2'-deoxy-2'-fluoroadenosine
  modified_base (73)..(73): 2'-deoxy-2'-fluorouridine
  modified_base (76)..(76): 2'-deoxy-2'-fluoroadenosine
  modified_base (79)..(79): 2'-deoxy-2'-fluoroguanosine
  modified_base (82)..(82): 2'-deoxy-2'-fluoroguanosine

SEQ ID NO: 357 - RNA, 86 nt, Artificial Sequence
  E101-3
  misc_feature (1)..(1): 5'-phosphorylated
  modified_base (6)..(6): 2'-deoxy-2'-fluoroadenosine
  modified_base (9)..(9): 2'-deoxy-2'-fluorouridine
  modified_base (12)..(12): 2'-deoxy-2'-fluoroguanosine
  modified_base (15)..(15): 2'-deoxy-2'-fluorouridine
  modified_base (18)..(18): 2'-deoxy-2'-fluoroadenosine
  modified_base (21)..(21): 2'-deoxy-2'-fluorouridine
  modified_base (24)..(24): 2'-deoxy-2'-fluoroguanosine
  modified_base (27)..(27): 2'-deoxy-2'-fluoroguanosine
  modified_base (30)..(30): 2'-deoxy-2'-fluoroguanosine
  modified_base (33)..(33): 2'-deoxy-2'-fluorouridine
  modified_base (36)..(36): 2'-deoxy-2'-fluoroadenosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluorocytidine
  modified_base (48)..(48): 2'-deoxy-2'-fluorouridine
  modified_base (51)..(51): 2'-deoxy-2'-fluorocytidine
  modified_base (54)..(54): 2'-deoxy-2'-fluorouridine
  modified_base (57)..(57): 2'-deoxy-2'-fluorocytidine
  modified_base (60)..(60): 2'-deoxy-2'-fluoroguanosine
  modified_base (63)..(63): 2'-deoxy-2'-fluorocytidine
  modified_base (66)..(66): 2'-deoxy-2'-fluoroadenosine
  modified_base (69)..(69): 2'-deoxy-2'-fluorouridine
  modified_base (72)..(72): 2'-deoxy-2'-fluorouridine
  modified_base (75)..(75): 2'-deoxy-2'-fluoroguanosine
  modified_base (78)..(78): 2'-deoxy-2'-fluorocytidine
  modified_base (81)..(81): 2'-deoxy-2'-fluorocytidine
  modified_base (84)..(84): 2'-O-methyluridine
  modified_base (85)..(85): 2'-O-methylguanosine
  modified_base (86)..(86): 2'-O-methyladenosine
uggacaaguacgccugcaacuguguuguuggcuacaucggggagcgcugucaguaccgagaccugaaguggugggaacugcgcuga

SEQ ID NO: 358 - RNA, 265 nt, Artificial Sequence; identical to SEQ ID NO: 354
  E102
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine
  modified_base (101)..(101): 2'-deoxy-2'-fluoroadenosine
  modified_base (104)..(104): 2'-deoxy-2'-fluoroadenosine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluorouridine
  modified_base (116)..(116): 2'-deoxy-2'-fluoroguanosine
  modified_base (119)..(119): 2'-deoxy-2'-fluorouridine
  modified_base (122)..(122): 2'-deoxy-2'-fluorocytidine
  modified_base (125)..(125): 2'-deoxy-2'-fluorocytidine
  modified_base (128)..(128): 2'-deoxy-2'-fluorouridine
  modified_base (131)..(131): 2'-deoxy-2'-fluorocytidine
  modified_base (134)..(134): 2'-deoxy-2'-fluoroguanosine
  modified_base (137)..(137): 2'-deoxy-2'-fluoroguanosine
  modified_base (140)..(140): 2'-deoxy-2'-fluorouridine
  modified_base (143)..(143): 2'-deoxy-2'-fluorouridine
  modified_base (146)..(146): 2'-deoxy-2'-fluorocytidine
  modified_base (149)..(149): 2'-deoxy-2'-fluorocytidine
  modified_base (152)..(152): 2'-deoxy-2'-fluoroguanosine
  modified_base (155)..(155): 2'-deoxy-2'-fluoroguanosine
  modified_base (158)..(158): 2'-deoxy-2'-fluoroguanosine
  modified_base (161)..(161): 2'-deoxy-2'-fluorouridine
  modified_base (164)..(164): 2'-deoxy-2'-fluoroadenosine
  modified_base (167)..(167): 2'-deoxy-2'-fluorouridine
  modified_base (170)..(170): 2'-deoxy-2'-fluoroadenosine
  modified_base (173)..(173): 2'-deoxy-2'-fluoroguanosine
  modified_base (176)..(176): 2'-deoxy-2'-fluoroguanosine
  modified_base (185)..(185): 2'-deoxy-2'-fluoroadenosine
  modified_base (188)..(188): 2'-deoxy-2'-fluorouridine
  modified_base (191)..(191): 2'-deoxy-2'-fluoroguanosine
  modified_base (194)..(194): 2'-deoxy-2'-fluorouridine
  modified_base (197)..(197): 2'-deoxy-2'-fluoroadenosine
  modified_base (200)..(200): 2'-deoxy-2'-fluorouridine
  modified_base (203)..(203): 2'-deoxy-2'-fluoroguanosine
  modified_base (206)..(206): 2'-deoxy-2'-fluoroguanosine
  modified_base (209)..(209): 2'-deoxy-2'-fluoroguanosine
  modified_base (212)..(212): 2'-deoxy-2'-fluorouridine
  modified_base (215)..(215): 2'-deoxy-2'-fluoroadenosine
  modified_base (218)..(218): 2'-deoxy-2'-fluoroguanosine
  modified_base (221)..(221): 2'-deoxy-2'-fluoroguanosine
  modified_base (224)..(224): 2'-deoxy-2'-fluorocytidine
  modified_base (227)..(227): 2'-deoxy-2'-fluorouridine
  modified_base (230)..(230): 2'-deoxy-2'-fluorocytidine
  modified_base (233)..(233): 2'-deoxy-2'-fluorouridine
  modified_base (236)..(236): 2'-deoxy-2'-fluorocytidine
  modified_base (239)..(239): 2'-deoxy-2'-fluoroguanosine
  modified_base (242)..(242): 2'-deoxy-2'-fluorocytidine
  modified_base (245)..(245): 2'-deoxy-2'-fluoroadenosine
  modified_base (248)..(248): 2'-deoxy-2'-fluorouridine
  modified_base (251)..(251): 2'-deoxy-2'-fluorouridine
  modified_base (254)..(254): 2'-deoxy-2'-fluoroguanosine
  modified_base (257)..(257): 2'-deoxy-2'-fluorocytidine
  modified_base (260)..(260): 2'-deoxy-2'-fluorocytidine
  misc_feature (263)..(264): 5'-phosphonothioate
  modified_base (263)..(263): 2'-O-methoxyethyluridine
  misc_feature (264)..(265): 5'-phosphonothioate
  modified_base (264)..(264): 2'-O-methoxyethylguanosine
  modified_base (265)..(265): 2'-O-methoxyethyladenosine

SEQ ID NO: 359 - RNA, 94 nt, Artificial Sequence; identical to SEQ ID NO: 80
  E102-1
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine

SEQ ID NO: 360 - RNA, 85 nt, Artificial Sequence; identical to SEQ ID NO: 81
  E102-2
  misc_feature (1)..(1): 5'-phosphorylated
  modified_base (7)..(7): 2'-deoxy-2'-fluoroadenosine
  modified_base (10)..(10): 2'-deoxy-2'-fluoroadenosine
  modified_base (13)..(13): 2'-deoxy-2'-fluoroadenosine
  modified_base (16)..(16): 2'-deoxy-2'-fluoroguanosine
  modified_base (19)..(19): 2'-deoxy-2'-fluorouridine
  modified_base (22)..(22): 2'-deoxy-2'-fluoroguanosine
  modified_base (25)..(25): 2'-deoxy-2'-fluorouridine
  modified_base (28)..(28): 2'-deoxy-2'-fluorocytidine
  modified_base (31)..(31): 2'-deoxy-2'-fluorocytidine
  modified_base (34)..(34): 2'-deoxy-2'-fluorouridine
  modified_base (37)..(37): 2'-deoxy-2'-fluorocytidine
  modified_base (40)..(40): 2'-deoxy-2'-fluoroguanosine
  modified_base (43)..(43): 2'-deoxy-2'-fluoroguanosine
  modified_base (46)..(46): 2'-deoxy-2'-fluorouridine
  modified_base (49)..(49): 2'-deoxy-2'-fluorouridine
  modified_base (52)..(52): 2'-deoxy-2'-fluorocytidine
  modified_base (55)..(55): 2'-deoxy-2'-fluorocytidine
  modified_base (58)..(58): 2'-deoxy-2'-fluoroguanosine
  modified_base (61)..(61): 2'-deoxy-2'-fluoroguanosine
  modified_base (64)..(64): 2'-deoxy-2'-fluoroguanosine
  modified_base (67)..(67): 2'-deoxy-2'-fluorouridine
  modified_base (70)..(70): 2'-deoxy-2'-fluoroadenosine
  modified_base (73)..(73): 2'-deoxy-2'-fluorouridine
  modified_base (76)..(76): 2'-deoxy-2'-fluoroadenosine
  modified_base (79)..(79): 2'-deoxy-2'-fluoroguanosine
  modified_base (82)..(82): 2'-deoxy-2'-fluoroguanosine

SEQ ID NO: 361 - RNA, 86 nt, Artificial Sequence; identical to SEQ ID NO: 357
  E102-3
  misc_feature (1)..(1): 5'-phosphorylated
  modified_base (6)..(6): 2'-deoxy-2'-fluoroadenosine
  modified_base (9)..(9): 2'-deoxy-2'-fluorouridine
  modified_base (12)..(12): 2'-deoxy-2'-fluoroguanosine
  modified_base (15)..(15): 2'-deoxy-2'-fluorouridine
  modified_base (18)..(18): 2'-deoxy-2'-fluoroadenosine
  modified_base (21)..(21): 2'-deoxy-2'-fluorouridine
  modified_base (24)..(24): 2'-deoxy-2'-fluoroguanosine
  modified_base (27)..(27): 2'-deoxy-2'-fluoroguanosine
  modified_base (30)..(30): 2'-deoxy-2'-fluoroguanosine
  modified_base (33)..(33): 2'-deoxy-2'-fluorouridine
  modified_base (36)..(36): 2'-deoxy-2'-fluoroadenosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluorocytidine
  modified_base (48)..(48): 2'-deoxy-2'-fluorouridine
  modified_base (51)..(51): 2'-deoxy-2'-fluorocytidine
  modified_base (54)..(54): 2'-deoxy-2'-fluorouridine
  modified_base (57)..(57): 2'-deoxy-2'-fluorocytidine
  modified_base (60)..(60): 2'-deoxy-2'-fluoroguanosine
  modified_base (63)..(63): 2'-deoxy-2'-fluorocytidine
  modified_base (66)..(66): 2'-deoxy-2'-fluoroadenosine
  modified_base (69)..(69): 2'-deoxy-2'-fluorouridine
  modified_base (72)..(72): 2'-deoxy-2'-fluorouridine
  modified_base (75)..(75): 2'-deoxy-2'-fluoroguanosine
  modified_base (78)..(78): 2'-deoxy-2'-fluorocytidine
  modified_base (81)..(81): 2'-deoxy-2'-fluorocytidine
  misc_feature (84)..(85): 5'-phosphonothioate
  modified_base (84)..(84): 2'-O-methoxyethyluridine
  misc_feature (85)..(86): 5'-phosphonothioate
  modified_base (85)..(85): 2'-O-methoxyethylguanosine
  modified_base (86)..(86): 2'-O-methoxyethyladenosine

SEQ ID NO: 362 - RNA, 265 nt, Artificial Sequence; identical to SEQ ID NO: 354
  E103
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine
  modified_base (101)..(101): 2'-deoxy-2'-fluoroadenosine
  modified_base (104)..(104): 2'-deoxy-2'-fluoroadenosine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluorouridine
  modified_base (116)..(116): 2'-deoxy-2'-fluoroguanosine
  modified_base (119)..(119): 2'-deoxy-2'-fluorouridine
  modified_base (122)..(122): 2'-deoxy-2'-fluorocytidine
  modified_base (125)..(125): 2'-deoxy-2'-fluorocytidine
  modified_base (128)..(128): 2'-deoxy-2'-fluorouridine
  modified_base (131)..(131): 2'-deoxy-2'-fluorocytidine
  modified_base (134)..(134): 2'-deoxy-2'-fluoroguanosine
  modified_base (137)..(137): 2'-deoxy-2'-fluoroguanosine
  modified_base (140)..(140): 2'-deoxy-2'-fluorouridine
  modified_base (143)..(143): 2'-deoxy-2'-fluorouridine
  modified_base (146)..(146): 2'-deoxy-2'-fluorocytidine
  modified_base (149)..(149): 2'-deoxy-2'-fluorocytidine
  modified_base (152)..(152): 2'-deoxy-2'-fluoroguanosine
  modified_base (155)..(155): 2'-deoxy-2'-fluoroguanosine
  modified_base (158)..(158): 2'-deoxy-2'-fluoroguanosine
  modified_base (161)..(161): 2'-deoxy-2'-fluorouridine
  modified_base (164)..(164): 2'-deoxy-2'-fluoroadenosine
  modified_base (167)..(167): 2'-deoxy-2'-fluorouridine
  modified_base (170)..(170): 2'-deoxy-2'-fluoroadenosine
  modified_base (173)..(173): 2'-deoxy-2'-fluoroguanosine
  modified_base (176)..(176): 2'-deoxy-2'-fluoroguanosine
  modified_base (185)..(185): 2'-deoxy-2'-fluoroadenosine
  modified_base (188)..(188): 2'-deoxy-2'-fluorouridine
  modified_base (191)..(191): 2'-deoxy-2'-fluoroguanosine
  modified_base (194)..(194): 2'-deoxy-2'-fluorouridine
  modified_base (197)..(197): 2'-deoxy-2'-fluoroadenosine
  modified_base (200)..(200): 2'-deoxy-2'-fluorouridine
  modified_base (203)..(203): 2'-deoxy-2'-fluoroguanosine
  modified_base (206)..(206): 2'-deoxy-2'-fluoroguanosine
  modified_base (209)..(209): 2'-deoxy-2'-fluoroguanosine
  modified_base (212)..(212): 2'-deoxy-2'-fluorouridine
  modified_base (215)..(215): 2'-deoxy-2'-fluoroadenosine
  modified_base (218)..(218): 2'-deoxy-2'-fluoroguanosine
  modified_base (221)..(221): 2'-deoxy-2'-fluoroguanosine
  modified_base (224)..(224): 2'-deoxy-2'-fluorocytidine
  modified_base (227)..(227): 2'-deoxy-2'-fluorouridine
  modified_base (230)..(230): 2'-deoxy-2'-fluorocytidine
  modified_base (233)..(233): 2'-deoxy-2'-fluorouridine
  modified_base (236)..(236): 2'-deoxy-2'-fluorocytidine
  modified_base (239)..(239): 2'-deoxy-2'-fluoroguanosine
  modified_base (242)..(242): 2'-deoxy-2'-fluorocytidine
  modified_base (245)..(245): 2'-deoxy-2'-fluoroadenosine
  modified_base (248)..(248): 2'-deoxy-2'-fluorouridine
  modified_base (251)..(251): 2'-deoxy-2'-fluorouridine
  modified_base (254)..(254): 2'-deoxy-2'-fluoroguanosine
  modified_base (257)..(257): 2'-deoxy-2'-fluorocytidine
  modified_base (260)..(260): 2'-deoxy-2'-fluorocytidine
  misc_feature (263)..(264): 5'-phosphonothioate
  modified_base (263)..(263): 2'-O-methyluridine
  misc_feature (264)..(265): 5'-phosphonothioate
  modified_base (264)..(264): 2'-deoxy-2'-fluoroguanosine
  modified_base (265)..(265): 2'-O-methyladenosine

SEQ ID NO: 363 - RNA, 94 nt, Artificial Sequence; identical to SEQ ID NO: 80
  E103-1
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine

SEQ ID NO: 364 - RNA, 85 nt, Artificial Sequence; identical to SEQ ID NO: 81
  E103-2
  misc_feature (1)..(1): 5'-phosphorylated
  modified_base (7)..(7): 2'-deoxy-2'-fluoroadenosine
  modified_base (10)..(10): 2'-deoxy-2'-fluoroadenosine
  modified_base (13)..(13): 2'-deoxy-2'-fluoroadenosine
  modified_base (16)..(16): 2'-deoxy-2'-fluoroguanosine
  modified_base (19)..(19): 2'-deoxy-2'-fluorouridine
  modified_base (22)..(22): 2'-deoxy-2'-fluoroguanosine
  modified_base (25)..(25): 2'-deoxy-2'-fluorouridine
  modified_base (28)..(28): 2'-deoxy-2'-fluorocytidine
  modified_base (31)..(31): 2'-deoxy-2'-fluorocytidine
  modified_base (34)..(34): 2'-deoxy-2'-fluorouridine
  modified_base (37)..(37): 2'-deoxy-2'-fluorocytidine
  modified_base (40)..(40): 2'-deoxy-2'-fluoroguanosine
  modified_base (43)..(43): 2'-deoxy-2'-fluoroguanosine
  modified_base (46)..(46): 2'-deoxy-2'-fluorouridine
  modified_base (49)..(49): 2'-deoxy-2'-fluorouridine
  modified_base (52)..(52): 2'-deoxy-2'-fluorocytidine
  modified_base (55)..(55): 2'-deoxy-2'-fluorocytidine
  modified_base (58)..(58): 2'-deoxy-2'-fluoroguanosine
  modified_base (61)..(61): 2'-deoxy-2'-fluoroguanosine
  modified_base (64)..(64): 2'-deoxy-2'-fluoroguanosine
  modified_base (67)..(67): 2'-deoxy-2'-fluorouridine
  modified_base (70)..(70): 2'-deoxy-2'-fluoroadenosine
  modified_base (73)..(73): 2'-deoxy-2'-fluorouridine
  modified_base (76)..(76): 2'-deoxy-2'-fluoroadenosine
  modified_base (79)..(79): 2'-deoxy-2'-fluoroguanosine
  modified_base (82)..(82): 2'-deoxy-2'-fluoroguanosine

SEQ ID NO: 365 - RNA, 86 nt, Artificial Sequence; identical to SEQ ID NO: 357
  E103-3
  misc_feature (1)..(1): 5'-phosphorylated
  modified_base (6)..(6): 2'-deoxy-2'-fluoroadenosine
  modified_base (9)..(9): 2'-deoxy-2'-fluorouridine
  modified_base (12)..(12): 2'-deoxy-2'-fluoroguanosine
  modified_base (15)..(15): 2'-deoxy-2'-fluorouridine
  modified_base (18)..(18): 2'-deoxy-2'-fluoroadenosine
  modified_base (21)..(21): 2'-deoxy-2'-fluorouridine
  modified_base (24)..(24): 2'-deoxy-2'-fluoroguanosine
  modified_base (27)..(27): 2'-deoxy-2'-fluoroguanosine
  modified_base (30)..(30): 2'-deoxy-2'-fluoroguanosine
  modified_base (33)..(33): 2'-deoxy-2'-fluorouridine
  modified_base (36)..(36): 2'-deoxy-2'-fluoroadenosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluorocytidine
  modified_base (48)..(48): 2'-deoxy-2'-fluorouridine
  modified_base (51)..(51): 2'-deoxy-2'-fluorocytidine
  modified_base (54)..(54): 2'-deoxy-2'-fluorouridine
  modified_base (57)..(57): 2'-deoxy-2'-fluorocytidine
  modified_base (60)..(60): 2'-deoxy-2'-fluoroguanosine
  modified_base (63)..(63): 2'-deoxy-2'-fluorocytidine
  modified_base (66)..(66): 2'-deoxy-2'-fluoroadenosine
  modified_base (69)..(69): 2'-deoxy-2'-fluorouridine
  modified_base (72)..(72): 2'-deoxy-2'-fluorouridine
  modified_base (75)..(75): 2'-deoxy-2'-fluoroguanosine
  modified_base (78)..(78): 2'-deoxy-2'-fluorocytidine
  modified_base (81)..(81): 2'-deoxy-2'-fluorocytidine
  misc_feature (84)..(85): 5'-phosphonothioate
  modified_base (84)..(84): 2'-O-methyluridine
  misc_feature (85)..(86): 5'-phosphonothioate
  modified_base (85)..(85): 2'-deoxy-2'-fluoroguanosine
  modified_base (86)..(86): 2'-O-methyladenosine

SEQ ID NO: 366 - RNA, 265 nt, Artificial Sequence; identical to SEQ ID NO: 354
  E104
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine
  modified_base (101)..(101): 2'-deoxy-2'-fluoroadenosine
  modified_base (104)..(104): 2'-deoxy-2'-fluoroadenosine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluorouridine
  modified_base (116)..(116): 2'-deoxy-2'-fluoroguanosine
  modified_base (119)..(119): 2'-deoxy-2'-fluorouridine
  modified_base (122)..(122): 2'-deoxy-2'-fluorocytidine
  modified_base (125)..(125): 2'-deoxy-2'-fluorocytidine
  modified_base (128)..(128): 2'-deoxy-2'-fluorouridine
  modified_base (131)..(131): 2'-deoxy-2'-fluorocytidine
  modified_base (134)..(134): 2'-deoxy-2'-fluoroguanosine
  modified_base (137)..(137): 2'-deoxy-2'-fluoroguanosine
  modified_base (140)..(140): 2'-deoxy-2'-fluorouridine
  modified_base (143)..(143): 2'-deoxy-2'-fluorouridine
  modified_base (146)..(146): 2'-deoxy-2'-fluorocytidine
  modified_base (149)..(149): 2'-deoxy-2'-fluorocytidine
  modified_base (152)..(152): 2'-deoxy-2'-fluoroguanosine
  modified_base (155)..(155): 2'-deoxy-2'-fluoroguanosine
  modified_base (158)..(158): 2'-deoxy-2'-fluoroguanosine
  modified_base (161)..(161): 2'-deoxy-2'-fluorouridine
  modified_base (164)..(164): 2'-deoxy-2'-fluoroadenosine
  modified_base (167)..(167): 2'-deoxy-2'-fluorouridine
  modified_base (170)..(170): 2'-deoxy-2'-fluoroadenosine
  modified_base (173)..(173): 2'-deoxy-2'-fluoroguanosine
  modified_base (176)..(176): 2'-deoxy-2'-fluoroguanosine
  modified_base (185)..(185): 2'-deoxy-2'-fluoroadenosine
  modified_base (188)..(188): 2'-deoxy-2'-fluorouridine
  modified_base (191)..(191): 2'-deoxy-2'-fluoroguanosine
  modified_base (194)..(194): 2'-deoxy-2'-fluorouridine
  modified_base (197)..(197): 2'-deoxy-2'-fluoroadenosine
  modified_base (200)..(200): 2'-deoxy-2'-fluorouridine
  modified_base (203)..(203): 2'-deoxy-2'-fluoroguanosine
  modified_base (206)..(206): 2'-deoxy-2'-fluoroguanosine
  modified_base (209)..(209): 2'-deoxy-2'-fluoroguanosine
  modified_base (212)..(212): 2'-deoxy-2'-fluorouridine
  modified_base (215)..(215): 2'-deoxy-2'-fluoroadenosine
  modified_base (218)..(218): 2'-deoxy-2'-fluoroguanosine
  modified_base (221)..(221): 2'-deoxy-2'-fluoroguanosine
  modified_base (224)..(224): 2'-deoxy-2'-fluorocytidine
  modified_base (227)..(227): 2'-deoxy-2'-fluorouridine
  modified_base (230)..(230): 2'-deoxy-2'-fluorocytidine
  modified_base (233)..(233): 2'-deoxy-2'-fluorouridine
  modified_base (236)..(236): 2'-deoxy-2'-fluorocytidine
  modified_base (239)..(239): 2'-deoxy-2'-fluoroguanosine
  modified_base (242)..(242): 2'-deoxy-2'-fluorocytidine
  modified_base (245)..(245): 2'-deoxy-2'-fluoroadenosine
  modified_base (248)..(248): 2'-deoxy-2'-fluorouridine
  modified_base (251)..(251): 2'-deoxy-2'-fluorouridine
  modified_base (254)..(254): 2'-deoxy-2'-fluoroguanosine
  modified_base (257)..(257): 2'-deoxy-2'-fluorocytidine
  modified_base (260)..(260): 2'-deoxy-2'-fluorocytidine
  modified_base (263)..(263): 2'-O-methoxyethyluridine
  modified_base (264)..(264): 2'-O-methoxyethylguanosine
  modified_base (265)..(265): 2'-O-methoxyethyladenosine

SEQ ID NO: 367 - RNA, 94 nt, Artificial Sequence; identical to SEQ ID NO: 80
  E104-1
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine

SEQ ID NO: 368 - RNA, 85 nt, Artificial Sequence; identical to SEQ ID NO: 81
  E104-2
  misc_feature (1)..(1): 5'-phosphorylated
  modified_base (7)..(7): 2'-deoxy-2'-fluoroadenosine
  modified_base (10)..(10): 2'-deoxy-2'-fluoroadenosine
  modified_base (13)..(13): 2'-deoxy-2'-fluoroadenosine
  modified_base (16)..(16): 2'-deoxy-2'-fluoroguanosine
  modified_base (19)..(19): 2'-deoxy-2'-fluorouridine
  modified_base (22)..(22): 2'-deoxy-2'-fluoroguanosine
  modified_base (25)..(25): 2'-deoxy-2'-fluorouridine
  modified_base (28)..(28): 2'-deoxy-2'-fluorocytidine
  modified_base (31)..(31): 2'-deoxy-2'-fluorocytidine
  modified_base (34)..(34): 2'-deoxy-2'-fluorouridine
  modified_base (37)..(37): 2'-deoxy-2'-fluorocytidine
  modified_base (40)..(40): 2'-deoxy-2'-fluoroguanosine
  modified_base (43)..(43): 2'-deoxy-2'-fluoroguanosine
  modified_base (46)..(46): 2'-deoxy-2'-fluorouridine
  modified_base (49)..(49): 2'-deoxy-2'-fluorouridine
  modified_base (52)..(52): 2'-deoxy-2'-fluorocytidine
  modified_base (55)..(55): 2'-deoxy-2'-fluorocytidine
  modified_base (58)..(58): 2'-deoxy-2'-fluoroguanosine
  modified_base (61)..(61): 2'-deoxy-2'-fluoroguanosine
  modified_base (64)..(64): 2'-deoxy-2'-fluoroguanosine
  modified_base (67)..(67): 2'-deoxy-2'-fluorouridine
  modified_base (70)..(70): 2'-deoxy-2'-fluoroadenosine
  modified_base (73)..(73): 2'-deoxy-2'-fluorouridine
  modified_base (76)..(76): 2'-deoxy-2'-fluoroadenosine
  modified_base (79)..(79): 2'-deoxy-2'-fluoroguanosine
  modified_base (82)..(82): 2'-deoxy-2'-fluoroguanosine

SEQ ID NO: 369 - RNA, 86 nt, Artificial Sequence; identical to SEQ ID NO: 357
  E104-3
  misc_feature (1)..(1): 5'-phosphorylated
  modified_base (6)..(6): 2'-deoxy-2'-fluoroadenosine
  modified_base (9)..(9): 2'-deoxy-2'-fluorouridine
  modified_base (12)..(12): 2'-deoxy-2'-fluoroguanosine
  modified_base (15)..(15): 2'-deoxy-2'-fluorouridine
  modified_base (18)..(18): 2'-deoxy-2'-fluoroadenosine
  modified_base (21)..(21): 2'-deoxy-2'-fluorouridine
  modified_base (24)..(24): 2'-deoxy-2'-fluoroguanosine
  modified_base (27)..(27): 2'-deoxy-2'-fluoroguanosine
  modified_base (30)..(30): 2'-deoxy-2'-fluoroguanosine
  modified_base (33)..(33): 2'-deoxy-2'-fluorouridine
  modified_base (36)..(36): 2'-deoxy-2'-fluoroadenosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluorocytidine
  modified_base (48)..(48): 2'-deoxy-2'-fluorouridine
  modified_base (51)..(51): 2'-deoxy-2'-fluorocytidine
  modified_base (54)..(54): 2'-deoxy-2'-fluorouridine
  modified_base (57)..(57): 2'-deoxy-2'-fluorocytidine
  modified_base (60)..(60): 2'-deoxy-2'-fluoroguanosine
  modified_base (63)..(63): 2'-deoxy-2'-fluorocytidine
  modified_base (66)..(66): 2'-deoxy-2'-fluoroadenosine
  modified_base (69)..(69): 2'-deoxy-2'-fluorouridine
  modified_base (72)..(72): 2'-deoxy-2'-fluorouridine
  modified_base (75)..(75): 2'-deoxy-2'-fluoroguanosine
  modified_base (78)..(78): 2'-deoxy-2'-fluorocytidine
  modified_base (81)..(81): 2'-deoxy-2'-fluorocytidine
  modified_base (84)..(84): 2'-O-methoxyethyluridine
  modified_base (85)..(85): 2'-O-methoxyethylguanosine
  modified_base (86)..(86): 2'-O-methoxyethyladenosine

SEQ ID NO: 370 - RNA, 265 nt, Artificial Sequence; identical to SEQ ID NO: 354
  E105
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine
  modified_base (101)..(101): 2'-deoxy-2'-fluoroadenosine
  modified_base (104)..(104): 2'-deoxy-2'-fluoroadenosine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluorouridine
  modified_base (116)..(116): 2'-deoxy-2'-fluoroguanosine
  modified_base (119)..(119): 2'-deoxy-2'-fluorouridine
  modified_base (122)..(122): 2'-deoxy-2'-fluorocytidine
  modified_base (125)..(125): 2'-deoxy-2'-fluorocytidine
  modified_base (128)..(128): 2'-deoxy-2'-fluorouridine
  modified_base (131)..(131): 2'-deoxy-2'-fluorocytidine
  modified_base (134)..(134): 2'-deoxy-2'-fluoroguanosine
  modified_base (137)..(137): 2'-deoxy-2'-fluoroguanosine
  modified_base (140)..(140): 2'-deoxy-2'-fluorouridine
  modified_base (143)..(143): 2'-deoxy-2'-fluorouridine
  modified_base (146)..(146): 2'-deoxy-2'-fluorocytidine
  modified_base (149)..(149): 2'-deoxy-2'-fluorocytidine
  modified_base (152)..(152): 2'-deoxy-2'-fluoroguanosine
  modified_base (155)..(155): 2'-deoxy-2'-fluoroguanosine
  modified_base (158)..(158): 2'-deoxy-2'-fluoroguanosine
  modified_base (161)..(161): 2'-deoxy-2'-fluorouridine
  modified_base (164)..(164): 2'-deoxy-2'-fluoroadenosine
  modified_base (167)..(167): 2'-deoxy-2'-fluorouridine
  modified_base (170)..(170): 2'-deoxy-2'-fluoroadenosine
  modified_base (173)..(173): 2'-deoxy-2'-fluoroguanosine
  modified_base (176)..(176): 2'-deoxy-2'-fluoroguanosine
  modified_base (185)..(185): 2'-deoxy-2'-fluoroadenosine
  modified_base (188)..(188): 2'-deoxy-2'-fluorouridine
  modified_base (191)..(191): 2'-deoxy-2'-fluoroguanosine
  modified_base (194)..(194): 2'-deoxy-2'-fluorouridine
  modified_base (197)..(197): 2'-deoxy-2'-fluoroadenosine
  modified_base (200)..(200): 2'-deoxy-2'-fluorouridine
  modified_base (203)..(203): 2'-deoxy-2'-fluoroguanosine
  modified_base (206)..(206): 2'-deoxy-2'-fluoroguanosine
  modified_base (209)..(209): 2'-deoxy-2'-fluoroguanosine
  modified_base (212)..(212): 2'-deoxy-2'-fluorouridine
  modified_base (215)..(215): 2'-deoxy-2'-fluoroadenosine
  modified_base (218)..(218): 2'-deoxy-2'-fluoroguanosine
  modified_base (221)..(221): 2'-deoxy-2'-fluoroguanosine
  modified_base (224)..(224): 2'-deoxy-2'-fluorocytidine
  modified_base (227)..(227): 2'-deoxy-2'-fluorouridine
  modified_base (230)..(230): 2'-deoxy-2'-fluorocytidine
  modified_base (233)..(233): 2'-deoxy-2'-fluorouridine
  modified_base (236)..(236): 2'-deoxy-2'-fluorocytidine
  modified_base (239)..(239): 2'-deoxy-2'-fluoroguanosine
  modified_base (242)..(242): 2'-deoxy-2'-fluorocytidine
  modified_base (245)..(245): 2'-deoxy-2'-fluoroadenosine
  modified_base (248)..(248): 2'-deoxy-2'-fluorouridine
  modified_base (251)..(251): 2'-deoxy-2'-fluorouridine
  modified_base (254)..(254): 2'-deoxy-2'-fluoroguanosine
  modified_base (257)..(257): 2'-deoxy-2'-fluorocytidine
  modified_base (260)..(260): 2'-deoxy-2'-fluorocytidine
  modified_base (263)..(263): 2'-O-methyluridine
  modified_base (264)..(264): 2'-deoxy-2'-fluoroguanosine
  modified_base (265)..(265): 2'-O-methyladenosine

SEQ ID NO: 371 - RNA, 94 nt, Artificial Sequence; identical to SEQ ID NO: 80
  E105-1
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methylcytidine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroadenosine
  modified_base (41)..(41): 2'-deoxy-2'-fluoroadenosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluoroguanosine
  modified_base (71)..(71): 2'-deoxy-2'-fluoroguanosine
  modified_base (74)..(74): 2'-deoxy-2'-fluoroguanosine
  modified_base (77)..(77): 2'-deoxy-2'-fluorouridine
  modified_base (80)..(80): 2'-deoxy-2'-fluoroadenosine
  modified_base (83)..(83): 2'-deoxy-2'-fluoroguanosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroguanosine

SEQ ID NO: 372 - RNA, 85 nt, Artificial Sequence; identical to SEQ ID NO: 81
  E105-2
  misc_feature (1)..(1): 5'-phosphorylated
  modified_base (7)..(7): 2'-deoxy-2'-fluoroadenosine
  modified_base (10)..(10): 2'-deoxy-2'-fluoroadenosine
  modified_base (13)..(13): 2'-deoxy-2'-fluoroadenosine
  modified_base (16)..(16): 2'-deoxy-2'-fluoroguanosine
  modified_base (19)..(19): 2'-deoxy-2'-fluorouridine
  modified_base (22)..(22): 2'-deoxy-2'-fluoroguanosine
  modified_base (25)..(25): 2'-deoxy-2'-fluorouridine
  modified_base (28)..(28): 2'-deoxy-2'-fluorocytidine
  modified_base (31)..(31): 2'-deoxy-2'-fluorocytidine
  modified_base (34)..(34): 2'-deoxy-2'-fluorouridine
  modified_base (37)..(37): 2'-deoxy-2'-fluorocytidine
  modified_base (40)..(40): 2'-deoxy-2'-fluoroguanosine
  modified_base (43)..(43): 2'-deoxy-2'-fluoroguanosine
  modified_base (46)..(46): 2'-deoxy-2'-fluorouridine
  modified_base (49)..(49): 2'-deoxy-2'-fluorouridine
  modified_base (52)..(52): 2'-deoxy-2'-fluorocytidine
  modified_base (55)..(55): 2'-deoxy-2'-fluorocytidine
  modified_base (58)..(58): 2'-deoxy-2'-fluoroguanosine
  modified_base (61)..(61): 2'-deoxy-2'-fluoroguanosine
  modified_base (64)..(64): 2'-deoxy-2'-fluoroguanosine
  modified_base (67)..(67): 2'-deoxy-2'-fluorouridine
  modified_base (70)..(70): 2'-deoxy-2'-fluoroadenosine
  modified_base (73)..(73): 2'-deoxy-2'-fluorouridine
  modified_base (76)..(76): 2'-deoxy-2'-fluoroadenosine
  modified_base (79)..(79): 2'-deoxy-2'-fluoroguanosine
  modified_base (82)..(82): 2'-deoxy-2'-fluoroguanosine

SEQ ID NO: 373 - RNA, 86 nt, Artificial Sequence; identical to SEQ ID NO: 357
  E105-3
  misc_feature (1)..(1): 5'-phosphorylated
  modified_base (6)..(6): 2'-deoxy-2'-fluoroadenosine
  modified_base (9)..(9): 2'-deoxy-2'-fluorouridine
  modified_base (12)..(12): 2'-deoxy-2'-fluoroguanosine
  modified_base (15)..(15): 2'-deoxy-2'-fluorouridine
  modified_base (18)..(18): 2'-deoxy-2'-fluoroadenosine
  modified_base (21)..(21): 2'-deoxy-2'-fluorouridine
  modified_base (24)..(24): 2'-deoxy-2'-fluoroguanosine
  modified_base (27)..(27): 2'-deoxy-2'-fluoroguanosine
  modified_base (30)..(30): 2'-deoxy-2'-fluoroguanosine
  modified_base (33)..(33): 2'-deoxy-2'-fluorouridine
  modified_base (36)..(36): 2'-deoxy-2'-fluoroadenosine
  modified_base (39)..(39): 2'-deoxy-2'-fluoroguanosine
  modified_base (42)..(42): 2'-deoxy-2'-fluoroguanosine
  modified_base (45)..(45): 2'-deoxy-2'-fluorocytidine
  modified_base (48)..(48): 2'-deoxy-2'-fluorouridine
  modified_base (51)..(51): 2'-deoxy-2'-fluorocytidine
  modified_base (54)..(54): 2'-deoxy-2'-fluorouridine
  modified_base (57)..(57): 2'-deoxy-2'-fluorocytidine
  modified_base (60)..(60): 2'-deoxy-2'-fluoroguanosine
  modified_base (63)..(63): 2'-deoxy-2'-fluorocytidine
  modified_base (66)..(66): 2'-deoxy-2'-fluoroadenosine
  modified_base (69)..(69): 2'-deoxy-2'-fluorouridine
  modified_base (72)..(72): 2'-deoxy-2'-fluorouridine
  modified_base (75)..(75): 2'-deoxy-2'-fluoroguanosine
  modified_base (78)..(78): 2'-deoxy-2'-fluorocytidine
  modified_base (81)..(81): 2'-deoxy-2'-fluorocytidine
  modified_base (84)..(84): 2'-O-methyluridine
  modified_base (85)..(85): 2'-deoxy-2'-fluoroguanosine
  modified_base (86)..(86): 2'-O-methyladenosine

SEQ ID NO: 374 - RNA, 169 nt, Artificial Sequence; identical to SEQ ID NO: 83
  E106
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (80)..(80): 2'-deoxy-2'-fluoroguanosine
  modified_base (83)..(83): 2'-deoxy-2'-fluoroguanosine
  modified_base (86)..(86): 2'-deoxy-2'-fluoroguanosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluoroadenosine
  modified_base (128)..(128): 2'-deoxy-2'-fluoroadenosine
  modified_base (131)..(131): 2'-deoxy-2'-fluoroadenosine
  modified_base (134)..(134): 2'-deoxy-2'-fluoroadenosine
  modified_base (137)..(137): 2'-deoxy-2'-fluorouridine
  modified_base (140)..(140): 2'-deoxy-2'-fluoroguanosine
  modified_base (143)..(143): 2'-deoxy-2'-fluoroadenosine
  modified_base (146)..(146): 2'-deoxy-2'-fluorocytidine
  modified_base (149)..(149): 2'-deoxy-2'-fluorocytidine
  modified_base (152)..(152): 2'-deoxy-2'-fluorocytidine
  modified_base (155)..(155): 2'-deoxy-2'-fluorocytidine
  modified_base (158)..(158): 2'-deoxy-2'-fluorocytidine
  modified_base (161)..(161): 2'-deoxy-2'-fluorocytidine
  modified_base (164)..(164): 2'-deoxy-2'-fluorocytidine
  modified_base (167)..(167): 2'-O-methyluridine
  modified_base (168)..(168): 2'-O-methylguanosine
  modified_base (169)..(169): 2'-O-methyladenosine

SEQ ID NO: 375 - RNA, 89 nt, Artificial Sequence; identical to SEQ ID NO: 84
  E106-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (80)..(80): 2'-deoxy-2'-fluoroguanosine
  modified_base (83)..(83): 2'-deoxy-2'-fluoroguanosine
  modified_base (86)..(86): 2'-deoxy-2'-fluoroguanosine

SEQ ID NO: 376 - RNA, 80 nt, Artificial Sequence; identical to SEQ ID NO: 85
  E106-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroguanosine
  modified_base (15)..(15): 2'-deoxy-2'-fluorouridine
  modified_base (18)..(18): 2'-deoxy-2'-fluoroadenosine
  modified_base (21)..(21): 2'-deoxy-2'-fluoroguanosine
  modified_base (24)..(24): 2'-deoxy-2'-fluoroguanosine
  modified_base (27)..(27): 2'-deoxy-2'-fluoroguanosine
  modified_base (30)..(30): 2'-deoxy-2'-fluoroguanosine
  modified_base (33)..(33): 2'-deoxy-2'-fluoroadenosine
  modified_base (36)..(36): 2'-deoxy-2'-fluoroadenosine
  modified_base (39)..(39): 2'-deoxy-2'-fluoroadenosine
  modified_base (42)..(42): 2'-deoxy-2'-fluoroadenosine
  modified_base (45)..(45): 2'-deoxy-2'-fluoroadenosine
  modified_base (48)..(48): 2'-deoxy-2'-fluorouridine
  modified_base (51)..(51): 2'-deoxy-2'-fluoroguanosine
  modified_base (54)..(54): 2'-deoxy-2'-fluoroadenosine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-deoxy-2'-fluorocytidine
  modified_base (69)..(69): 2'-deoxy-2'-fluorocytidine
  modified_base (72)..(72): 2'-deoxy-2'-fluorocytidine
  modified_base (75)..(75): 2'-deoxy-2'-fluorocytidine
  modified_base (78)..(78): 2'-O-methyluridine
  modified_base (79)..(79): 2'-O-methylguanosine
  modified_base (80)..(80): 2'-O-methyladenosine

SEQ ID NO: 377 - RNA, 169 nt, Artificial Sequence; identical to SEQ ID NO: 83
  E107
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (80)..(80): 2'-deoxy-2'-fluoroguanosine
  modified_base (83)..(83): 2'-deoxy-2'-fluoroguanosine
  modified_base (86)..(86): 2'-deoxy-2'-fluoroguanosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluoroadenosine
  modified_base (128)..(128): 2'-deoxy-2'-fluoroadenosine
  modified_base (131)..(131): 2'-deoxy-2'-fluoroadenosine
  modified_base (134)..(134): 2'-deoxy-2'-fluoroadenosine
  modified_base (137)..(137): 2'-deoxy-2'-fluorouridine
  modified_base (140)..(140): 2'-deoxy-2'-fluoroguanosine
  modified_base (143)..(143): 2'-deoxy-2'-fluoroadenosine
  modified_base (146)..(146): 2'-deoxy-2'-fluorocytidine
  modified_base (149)..(149): 2'-deoxy-2'-fluorocytidine
  modified_base (152)..(152): 2'-deoxy-2'-fluorocytidine
  modified_base (155)..(155): 2'-deoxy-2'-fluorocytidine
  modified_base (158)..(158): 2'-deoxy-2'-fluorocytidine
  modified_base (161)..(161): 2'-deoxy-2'-fluorocytidine
  modified_base (164)..(164): 2'-deoxy-2'-fluorocytidine
  misc_feature (167)..(168): 5'-phosphonothioate
  modified_base (167)..(167): 2'-O-methoxyethyluridine
  misc_feature (168)..(169): 5'-phosphonothioate
  modified_base (168)..(168): 2'-O-methoxyethylguanosine
  modified_base (169)..(169): 2'-O-methoxyethyladenosine

SEQ ID NO: 378 - RNA, 89 nt, Artificial Sequence; identical to SEQ ID NO: 84
  E107-1
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (80)..(80): 2'-deoxy-2'-fluoroguanosine
  modified_base (83)..(83): 2'-deoxy-2'-fluoroguanosine
  modified_base (86)..(86): 2'-deoxy-2'-fluoroguanosine

SEQ ID NO: 379 - RNA, 80 nt, Artificial Sequence; identical to SEQ ID NO: 85
  E107-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroguanosine
  modified_base (15)..(15): 2'-deoxy-2'-fluorouridine
  modified_base (18)..(18): 2'-deoxy-2'-fluoroadenosine
  modified_base (21)..(21): 2'-deoxy-2'-fluoroguanosine
  modified_base (24)..(24): 2'-deoxy-2'-fluoroguanosine
  modified_base (27)..(27): 2'-deoxy-2'-fluoroguanosine
  modified_base (30)..(30): 2'-deoxy-2'-fluoroguanosine
  modified_base (33)..(33): 2'-deoxy-2'-fluoroadenosine
  modified_base (36)..(36): 2'-deoxy-2'-fluoroadenosine
  modified_base (39)..(39): 2'-deoxy-2'-fluoroadenosine
  modified_base (42)..(42): 2'-deoxy-2'-fluoroadenosine
  modified_base (45)..(45): 2'-deoxy-2'-fluoroadenosine
  modified_base (48)..(48): 2'-deoxy-2'-fluorouridine
  modified_base (51)..(51): 2'-deoxy-2'-fluoroguanosine
  modified_base (54)..(54): 2'-deoxy-2'-fluoroadenosine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-deoxy-2'-fluorocytidine
  modified_base (69)..(69): 2'-deoxy-2'-fluorocytidine
  modified_base (72)..(72): 2'-deoxy-2'-fluorocytidine
  modified_base (75)..(75): 2'-deoxy-2'-fluorocytidine
  misc_feature (78)..(79): 5'-phosphonothioate
  modified_base (78)..(78): 2'-O-methoxyethyluridine
  misc_feature (79)..(80): 5'-phosphonothioate
  modified_base (79)..(79): 2'-O-methoxyethylguanosine
  modified_base (80)..(80): 2'-O-methoxyethyladenosine

SEQ ID NO: 380 - RNA, 169 nt, Artificial Sequence; identical to SEQ ID NO: 83
  E108
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (80)..(80): 2'-deoxy-2'-fluoroguanosine
  modified_base (83)..(83): 2'-deoxy-2'-fluoroguanosine
  modified_base (86)..(86): 2'-deoxy-2'-fluoroguanosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluoroadenosine
  modified_base (128)..(128): 2'-deoxy-2'-fluoroadenosine
  modified_base (131)..(131): 2'-deoxy-2'-fluoroadenosine
  modified_base (134)..(134): 2'-deoxy-2'-fluoroadenosine
  modified_base (137)..(137): 2'-deoxy-2'-fluorouridine
  modified_base (140)..(140): 2'-deoxy-2'-fluoroguanosine
  modified_base (143)..(143): 2'-deoxy-2'-fluoroadenosine
  modified_base (146)..(146): 2'-deoxy-2'-fluorocytidine
  modified_base (149)..(149): 2'-deoxy-2'-fluorocytidine
  modified_base (152)..(152): 2'-deoxy-2'-fluorocytidine
  modified_base (155)..(155): 2'-deoxy-2'-fluorocytidine
  modified_base (158)..(158): 2'-deoxy-2'-fluorocytidine
  modified_base (161)..(161): 2'-deoxy-2'-fluorocytidine
  modified_base (164)..(164): 2'-deoxy-2'-fluorocytidine
  misc_feature (167)..(168): 5'-phosphonothioate
  modified_base (167)..(167): 2'-O-methyluridine
  misc_feature (168)..(169): 5'-phosphonothioate
  modified_base (168)..(168): 2'-deoxy-2'-fluoroguanosine
  modified_base (169)..(169): 2'-O-methyladenosine

SEQ ID NO: 381 - RNA, 89 nt, Artificial Sequence; identical to SEQ ID NO: 84
  E108-1
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (80)..(80): 2'-deoxy-2'-fluoroguanosine
  modified_base (83)..(83): 2'-deoxy-2'-fluoroguanosine
  modified_base (86)..(86): 2'-deoxy-2'-fluoroguanosine

SEQ ID NO: 382 - RNA, 80 nt, Artificial Sequence; identical to SEQ ID NO: 85
  E108-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroguanosine
  modified_base (15)..(15): 2'-deoxy-2'-fluorouridine
  modified_base (18)..(18): 2'-deoxy-2'-fluoroadenosine
  modified_base (21)..(21): 2'-deoxy-2'-fluoroguanosine
  modified_base (24)..(24): 2'-deoxy-2'-fluoroguanosine
  modified_base (27)..(27): 2'-deoxy-2'-fluoroguanosine
  modified_base (30)..(30): 2'-deoxy-2'-fluoroguanosine
  modified_base (33)..(33): 2'-deoxy-2'-fluoroadenosine
  modified_base (36)..(36): 2'-deoxy-2'-fluoroadenosine
  modified_base (39)..(39): 2'-deoxy-2'-fluoroadenosine
  modified_base (42)..(42): 2'-deoxy-2'-fluoroadenosine
  modified_base (45)..(45): 2'-deoxy-2'-fluoroadenosine
  modified_base (48)..(48): 2'-deoxy-2'-fluorouridine
  modified_base (51)..(51): 2'-deoxy-2'-fluoroguanosine
  modified_base (54)..(54): 2'-deoxy-2'-fluoroadenosine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-deoxy-2'-fluorocytidine
  modified_base (69)..(69): 2'-deoxy-2'-fluorocytidine
  modified_base (72)..(72): 2'-deoxy-2'-fluorocytidine
  modified_base (75)..(75): 2'-deoxy-2'-fluorocytidine
  misc_feature (78)..(79): 5'-phosphonothioate
  modified_base (78)..(78): 2'-O-methyluridine
  misc_feature (79)..(80): 5'-phosphonothioate
  modified_base (79)..(79): 2'-deoxy-2'-fluoroguanosine
  modified_base (80)..(80): 2'-O-methyladenosine

SEQ ID NO: 383 - RNA, 169 nt, Artificial Sequence; identical to SEQ ID NO: 83
  E109
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (80)..(80): 2'-deoxy-2'-fluoroguanosine
  modified_base (83)..(83): 2'-deoxy-2'-fluoroguanosine
  modified_base (86)..(86): 2'-deoxy-2'-fluoroguanosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluoroadenosine
  modified_base (128)..(128): 2'-deoxy-2'-fluoroadenosine
  modified_base (131)..(131): 2'-deoxy-2'-fluoroadenosine
  modified_base (134)..(134): 2'-deoxy-2'-fluoroadenosine
  modified_base (137)..(137): 2'-deoxy-2'-fluorouridine
  modified_base (140)..(140): 2'-deoxy-2'-fluoroguanosine
  modified_base (143)..(143): 2'-deoxy-2'-fluoroadenosine
  modified_base (146)..(146): 2'-deoxy-2'-fluorocytidine
  modified_base (149)..(149): 2'-deoxy-2'-fluorocytidine
  modified_base (152)..(152): 2'-deoxy-2'-fluorocytidine
  modified_base (155)..(155): 2'-deoxy-2'-fluorocytidine
  modified_base (158)..(158): 2'-deoxy-2'-fluorocytidine
  modified_base (161)..(161): 2'-deoxy-2'-fluorocytidine
  modified_base (164)..(164): 2'-deoxy-2'-fluorocytidine
  modified_base (167)..(167): 2'-O-methyluridine
  modified_base (168)..(168): 2'-deoxy-2'-fluoroguanosine
  modified_base (169)..(169): 2'-O-methyladenosine

SEQ ID NO: 384 - RNA, 89 nt, Artificial Sequence; identical to SEQ ID NO: 84
  E109-1
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (80)..(80): 2'-deoxy-2'-fluoroguanosine
  modified_base (83)..(83): 2'-deoxy-2'-fluoroguanosine
  modified_base (86)..(86): 2'-deoxy-2'-fluoroguanosine

SEQ ID NO: 385 - RNA, 80 nt, Artificial Sequence; identical to SEQ ID NO: 85
  E109-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroguanosine
  modified_base (15)..(15): 2'-deoxy-2'-fluorouridine
  modified_base (18)..(18): 2'-deoxy-2'-fluoroadenosine
  modified_base (21)..(21): 2'-deoxy-2'-fluoroguanosine
  modified_base (24)..(24): 2'-deoxy-2'-fluoroguanosine
  modified_base (27)..(27): 2'-deoxy-2'-fluoroguanosine
  modified_base (30)..(30): 2'-deoxy-2'-fluoroguanosine
  modified_base (33)..(33): 2'-deoxy-2'-fluoroadenosine
  modified_base (36)..(36): 2'-deoxy-2'-fluoroadenosine
  modified_base (39)..(39): 2'-deoxy-2'-fluoroadenosine
  modified_base (42)..(42): 2'-deoxy-2'-fluoroadenosine
  modified_base (45)..(45): 2'-deoxy-2'-fluoroadenosine
  modified_base (48)..(48): 2'-deoxy-2'-fluorouridine
  modified_base (51)..(51): 2'-deoxy-2'-fluoroguanosine
  modified_base (54)..(54): 2'-deoxy-2'-fluoroadenosine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorocytidine
  modified_base (66)..(66): 2'-deoxy-2'-fluorocytidine
  modified_base (69)..(69): 2'-deoxy-2'-fluorocytidine
  modified_base (72)..(72): 2'-deoxy-2'-fluorocytidine
  modified_base (75)..(75): 2'-deoxy-2'-fluorocytidine
  modified_base (78)..(78): 2'-O-methyluridine
  modified_base (79)..(79): 2'-deoxy-2'-fluoroguanosine
  modified_base (80)..(80): 2'-O-methyladenosine

SEQ ID NO: 386 - RNA, 145 nt, Artificial Sequence; identical to SEQ ID NO: 1
  E110
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  misc_feature (3)..(4): 5'-phosphonothioate
  modified_base (3)..(3): 2'-O-methoxyethylguanosine
  misc_feature (4)..(5): 5'-phosphonothioate
  modified_base (4)..(4): 2'-O-methoxyethyladenosine
  misc_feature (5)..(6): 5'-phosphonothioate
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  misc_feature (143)..(144): 5'-phosphonothioate
  modified_base (143)..(143): 2'-O-methoxyethyluridine
  misc_feature (144)..(145): 5'-phosphonothioate
  modified_base (144)..(144): 2'-O-methoxyethylguanosine
  modified_base (145)..(145): 2'-O-methoxyethyladenosine

SEQ ID NO: 387 - RNA, 80 nt, Artificial Sequence; identical to SEQ ID NO: 2
  E110-1
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  misc_feature (3)..(4): 5'-phosphonothioate
  modified_base (3)..(3): 2'-O-methoxyethylguanosine
  misc_feature (4)..(5): 5'-phosphonothioate
  modified_base (4)..(4): 2'-O-methoxyethyladenosine
  misc_feature (5)..(6): 5'-phosphonothioate
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 388 - RNA, 65 nt, Artificial Sequence; identical to SEQ ID NO: 3
  E110-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  misc_feature (63)..(64): 5'-phosphonothioate
  modified_base (63)..(63): 2'-O-methoxyethyluridine
  misc_feature (64)..(65): 5'-phosphonothioate
  modified_base (64)..(64): 2'-O-methoxyethylguanosine
  modified_base (65)..(65): 2'-O-methoxyethyladenosine

SEQ ID NO: 389 - RNA, 165 nt, Artificial Sequence; identical to SEQ ID NO: 5
  E111
  misc_feature (1)..(1): artificial danglingend
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methyluridine
  modified_base (144)..(144): 2'-O-methylguanosine
  modified_base (145)..(145): 2'-O-methyladenosine

SEQ ID NO: 390 - RNA, 80 nt, Artificial Sequence; identical to SEQ ID NO: 2
  E111-1
  misc_feature (1)..(1): artificial danglingend
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 391 - RNA, 85 nt, Artificial Sequence; identical to SEQ ID NO: 7
  E111-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methyluridine
  modified_base (64)..(64): 2'-O-methylguanosine
  modified_base (65)..(65): 2'-O-methyladenosine

SEQ ID NO: 392 - RNA, 145 nt, Artificial Sequence; identical to SEQ ID NO: 1
  E112
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (143)..(143): 2'-O-methyluridine
  modified_base (144)..(144): 2'-O-methylguanosine
  modified_base (145)..(145): 2'-O-methyladenosine

SEQ ID NO: 393 - RNA, 80 nt, Artificial Sequence; identical to SEQ ID NO: 2
  E112-1
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine

SEQ ID NO: 394 - RNA, 65 nt, Artificial Sequence; identical to SEQ ID NO: 3
  E112-2
  misc_feature (1)..(1): 5'-phosphorylated
  modified_base (63)..(63): 2'-O-methyluridine
  modified_base (64)..(64): 2'-O-methylguanosine
  modified_base (65)..(65): 2'-O-methyladenosine

SEQ ID NO: 395 - DNA, 185 bp, Artificial Sequence
  E113
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  modified_base (143)..(143): 2'-O-methoxyethylthymine
  modified_base (144)..(144): 2'-O-methoxyethylguanosine
  modified_base (145)..(145): 2'-O-methoxyethyladenosine
gggagaauacaagcuacuuguucuuuuugcagccaccauggacuacaaggacgacgacgacaagaucaucgacuauaaagacgacgacgauaaagguggcgacuauaaggacgacgacgacaaacaccaccaccaccaccactgaaaaaaaaaaaaaaaaaaaaaaaaaaaaaaaaaaaaaaaaa

SEQ ID NO: 396 - RNA, 80 nt, Artificial Sequence; identical to SEQ ID NO: 2
  E113-1
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 397 - DNA, 105 bp, Artificial Sequence
  E113-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  modified_base (63)..(63): 2'-O-methoxyethylthymine
  modified_base (64)..(64): 2'-O-methoxyethylguanosine
  modified_base (65)..(65): 2'-O-methoxyethyladenosine
acgacgacgauaaagguggcgacuauaaggacgacgacgacaaacaccaccaccaccaccactgaaaaaaaaaaaaaaaaaaaaaaaaaaaaaaaaaaaaaaaaa

SEQ ID NO: 398 - DNA, 185 bp, Artificial Sequence; identical to SEQ ID NO: 395
  E114
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine
  modified_base (86)..(86): 2'-deoxy-2'-fluoroguanosine
  modified_base (89)..(89): 2'-deoxy-2'-fluoroguanosine
  modified_base (92)..(92): 2'-deoxy-2'-fluoroadenosine
  modified_base (95)..(95): 2'-deoxy-2'-fluoroguanosine
  modified_base (98)..(98): 2'-deoxy-2'-fluoroguanosine
  modified_base (101)..(101): 2'-deoxy-2'-fluoroguanosine
  modified_base (104)..(104): 2'-deoxy-2'-fluorouridine
  modified_base (107)..(107): 2'-deoxy-2'-fluoroadenosine
  modified_base (110)..(110): 2'-deoxy-2'-fluoroguanosine
  modified_base (113)..(113): 2'-deoxy-2'-fluoroguanosine
  modified_base (116)..(116): 2'-deoxy-2'-fluoroguanosine
  modified_base (119)..(119): 2'-deoxy-2'-fluoroguanosine
  modified_base (122)..(122): 2'-deoxy-2'-fluoroadenosine
  modified_base (125)..(125): 2'-deoxy-2'-fluorocytidine
  modified_base (128)..(128): 2'-deoxy-2'-fluorocytidine
  modified_base (131)..(131): 2'-deoxy-2'-fluorocytidine
  modified_base (134)..(134): 2'-deoxy-2'-fluorocytidine
  modified_base (137)..(137): 2'-deoxy-2'-fluorocytidine
  modified_base (140)..(140): 2'-deoxy-2'-fluorocytidine
  misc_feature (143)..(144): 5'-phosphonothioate
  modified_base (143)..(143): 2'-O-methoxyethylthymine
  misc_feature (144)..(145): 5'-phosphonothioate
  modified_base (144)..(144): 2'-O-methoxyethylguanosine
  modified_base (145)..(145): 2'-O-methoxyethyladenosine

SEQ ID NO: 399 - RNA, 80 nt, Artificial Sequence; identical to SEQ ID NO: 2
  E114-1
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroadenosine
  modified_base (68)..(68): 2'-deoxy-2'-fluoroadenosine
  modified_base (71)..(71): 2'-deoxy-2'-fluoroguanosine
  modified_base (74)..(74): 2'-deoxy-2'-fluorouridine
  modified_base (77)..(77): 2'-deoxy-2'-fluoroadenosine

SEQ ID NO: 400 - DNA, 105 bp, Artificial Sequence; identical to SEQ ID NO: 397
  E114-2
  misc_feature (1)..(1): 5'-phosphorylated
  modified_base (6)..(6): 2'-deoxy-2'-fluoroguanosine
  modified_base (9)..(9): 2'-deoxy-2'-fluoroguanosine
  modified_base (12)..(12): 2'-deoxy-2'-fluoroadenosine
  modified_base (15)..(15): 2'-deoxy-2'-fluoroguanosine
  modified_base (18)..(18): 2'-deoxy-2'-fluoroguanosine
  modified_base (21)..(21): 2'-deoxy-2'-fluoroguanosine
  modified_base (24)..(24): 2'-deoxy-2'-fluorouridine
  modified_base (27)..(27): 2'-deoxy-2'-fluoroadenosine
  modified_base (30)..(30): 2'-deoxy-2'-fluoroguanosine
  modified_base (33)..(33): 2'-deoxy-2'-fluoroguanosine
  modified_base (36)..(36): 2'-deoxy-2'-fluoroguanosine
  modified_base (39)..(39): 2'-deoxy-2'-fluoroguanosine
  modified_base (42)..(42): 2'-deoxy-2'-fluoroadenosine
  modified_base (45)..(45): 2'-deoxy-2'-fluorocytidine
  modified_base (48)..(48): 2'-deoxy-2'-fluorocytidine
  modified_base (51)..(51): 2'-deoxy-2'-fluorocytidine
  modified_base (54)..(54): 2'-deoxy-2'-fluorocytidine
  modified_base (57)..(57): 2'-deoxy-2'-fluorocytidine
  modified_base (60)..(60): 2'-deoxy-2'-fluorocytidine
  misc_feature (63)..(64): 5'-phosphonothioate
  modified_base (63)..(63): 2'-O-methoxyethylthymine
  misc_feature (64)..(65): 5'-phosphonothioate
  modified_base (64)..(64): 2'-O-methoxyethylguanosine
  modified_base (65)..(65): 2'-O-methoxyethyladenosine

SEQ ID NO: 401 - RNA, 145 nt, Artificial Sequence; identical to SEQ ID NO: 1
  E115
  modified_base (1)..(1): 2'-O-methylguanosine
  modified_base (2)..(2): 2'-O-methylguanosine
  modified_base (3)..(3): 2'-O-methylguanosine
  modified_base (4)..(4): 2'-O-methyladenosine
  modified_base (5)..(5): 2'-O-methylguanosine
  modified_base (6)..(6): 2'-O-methyladenosine
  modified_base (143)..(143): 2'-O-methyluridine
  modified_base (144)..(144): 2'-O-methylguanosine
  modified_base (145)..(145): 2'-O-methyladenosine

SEQ ID NO: 402 - RNA, 94 nt, Artificial Sequence
  E116
gggagaauacaagcuacuuguucuuuuugcagccaccauggacuauaaggacgacgacgacaaagguggcagccaccaccaccaccaccacuga

SEQ ID NO: 403 - RNA, 67 nt, Artificial Sequence
  E117
gggagccaccauggacuauaaggacgacgacgacaaagguggcagccaccaccaccaccaccacuga

SEQ ID NO: 404 - RNA, 64 nt, Artificial Sequence; identical to SEQ ID NO: 306
  E118
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (62)..(62): 2'-O-methoxyethyluridine
  modified_base (63)..(63): 2'-O-methoxyethylguanosine
  modified_base (64)..(64): 2'-O-methoxyethyladenosine

SEQ ID NO: 405 - RNA, 94 nt, Artificial Sequence; identical to SEQ ID NO: 402
  E119
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (7)..(7): 2'-O-methoxyethyladenosine
  modified_base (92)..(92): 2'-O-methoxyethyluridine
  modified_base (93)..(93): 2'-O-methoxyethylguanosine
  modified_base (94)..(94): 2'-O-methoxyethyladenosine

SEQ ID NO: 406 - RNA, 67 nt, Artificial Sequence; identical to SEQ ID NO: 403
  E120
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (65)..(65): 2'-O-methoxyethyluridine
  modified_base (66)..(66): 2'-O-methoxyethylguanosine
  modified_base (67)..(67): 2'-O-methoxyethyladenosine

SEQ ID NO: 407 - RNA, 91 nt, Artificial Sequence; identical to SEQ ID NO: 302
  E121
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroguanosine
  modified_base (68)..(68): 2'-deoxy-2'-fluoroguanosine
  modified_base (71)..(71): 2'-deoxy-2'-fluorocytidine
  modified_base (74)..(74): 2'-deoxy-2'-fluorocytidine
  modified_base (77)..(77): 2'-deoxy-2'-fluorocytidine
  modified_base (80)..(80): 2'-deoxy-2'-fluorocytidine
  modified_base (83)..(83): 2'-deoxy-2'-fluorocytidine
  modified_base (86)..(86): 2'-deoxy-2'-fluorocytidine
  modified_base (89)..(89): 2'-O-methoxyethyluridine
  modified_base (90)..(90): 2'-O-methoxyethylguanosine
  modified_base (91)..(91): 2'-O-methoxyethyladenosine

SEQ ID NO: 408 - RNA, 88 nt, Artificial Sequence; identical to SEQ ID NO: 305
  E122
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroguanosine
  modified_base (41)..(41): 2'-deoxy-2'-fluoroguanosine
  modified_base (44)..(44): 2'-deoxy-2'-fluoroguanosine
  modified_base (47)..(47): 2'-deoxy-2'-fluorouridine
  modified_base (50)..(50): 2'-deoxy-2'-fluoroadenosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (65)..(65): 2'-deoxy-2'-fluoroadenosine
  modified_base (68)..(68): 2'-deoxy-2'-fluorocytidine
  modified_base (71)..(71): 2'-deoxy-2'-fluorocytidine
  modified_base (74)..(74): 2'-deoxy-2'-fluorocytidine
  modified_base (77)..(77): 2'-deoxy-2'-fluorocytidine
  modified_base (80)..(80): 2'-deoxy-2'-fluorocytidine
  modified_base (83)..(83): 2'-deoxy-2'-fluorocytidine
  modified_base (86)..(86): 2'-O-methoxyethyluridine
  modified_base (87)..(87): 2'-O-methoxyethylguanosine
  modified_base (88)..(88): 2'-O-methoxyethyladenosine

SEQ ID NO: 409 - RNA, 64 nt, Artificial Sequence; identical to SEQ ID NO: 306
  E123
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroguanosine
  modified_base (41)..(41): 2'-deoxy-2'-fluoroguanosine
  modified_base (44)..(44): 2'-deoxy-2'-fluorocytidine
  modified_base (47)..(47): 2'-deoxy-2'-fluorocytidine
  modified_base (50)..(50): 2'-deoxy-2'-fluorocytidine
  modified_base (53)..(53): 2'-deoxy-2'-fluorocytidine
  modified_base (56)..(56): 2'-deoxy-2'-fluorocytidine
  modified_base (59)..(59): 2'-deoxy-2'-fluorocytidine
  modified_base (62)..(62): 2'-O-methoxyethyluridine
  modified_base (63)..(63): 2'-O-methoxyethylguanosine
  modified_base (64)..(64): 2'-O-methoxyethyladenosine

SEQ ID NO: 410 - RNA, 94 nt, Artificial Sequence; identical to SEQ ID NO: 402
  E124
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (7)..(7): 2'-O-methoxyethyladenosine
  modified_base (38)..(38): 2'-deoxy-2'-fluoroadenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroguanosine
  modified_base (68)..(68): 2'-deoxy-2'-fluoroguanosine
  modified_base (71)..(71): 2'-deoxy-2'-fluoroadenosine
  modified_base (74)..(74): 2'-deoxy-2'-fluorocytidine
  modified_base (77)..(77): 2'-deoxy-2'-fluorocytidine
  modified_base (80)..(80): 2'-deoxy-2'-fluorocytidine
  modified_base (83)..(83): 2'-deoxy-2'-fluorocytidine
  modified_base (86)..(86): 2'-deoxy-2'-fluorocytidine
  modified_base (89)..(89): 2'-deoxy-2'-fluorocytidine
  modified_base (92)..(92): 2'-O-methoxyethyluridine
  modified_base (93)..(93): 2'-O-methoxyethylguanosine
  modified_base (94)..(94): 2'-O-methoxyethyladenosine

SEQ ID NO: 411 - RNA, 67 nt, Artificial Sequence; identical to SEQ ID NO: 403
  E125
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (14)..(14): 2'-deoxy-2'-fluoroguanosine
  modified_base (17)..(17): 2'-deoxy-2'-fluorouridine
  modified_base (20)..(20): 2'-deoxy-2'-fluoroadenosine
  modified_base (23)..(23): 2'-deoxy-2'-fluoroguanosine
  modified_base (26)..(26): 2'-deoxy-2'-fluoroguanosine
  modified_base (29)..(29): 2'-deoxy-2'-fluoroguanosine
  modified_base (32)..(32): 2'-deoxy-2'-fluoroguanosine
  modified_base (35)..(35): 2'-deoxy-2'-fluoroadenosine
  modified_base (38)..(38): 2'-deoxy-2'-fluoroguanosine
  modified_base (41)..(41): 2'-deoxy-2'-fluoroguanosine
  modified_base (44)..(44): 2'-deoxy-2'-fluoroadenosine
  modified_base (47)..(47): 2'-deoxy-2'-fluorocytidine
  modified_base (50)..(50): 2'-deoxy-2'-fluorocytidine
  modified_base (53)..(53): 2'-deoxy-2'-fluorocytidine
  modified_base (56)..(56): 2'-deoxy-2'-fluorocytidine
  modified_base (59)..(59): 2'-deoxy-2'-fluorocytidine
  modified_base (62)..(62): 2'-deoxy-2'-fluorocytidine
  modified_base (65)..(65): 2'-O-methoxyethyluridine
  modified_base (66)..(66): 2'-O-methoxyethylguanosine
  modified_base (67)..(67): 2'-O-methoxyethyladenosine

SEQ ID NO: 412 - RNA, 91 nt, Artificial Sequence; identical to SEQ ID NO: 302
  E126
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethylguanosine
  modified_base (6)..(6): 2'-O-methoxyethyladenosine
  modified_base (41)..(41): 2'-deoxy-2'-fluoroguanosine
  modified_base (44)..(44): 2'-deoxy-2'-fluorouridine
  modified_base (47)..(47): 2'-deoxy-2'-fluoroadenosine
  modified_base (50)..(50): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroadenosine
  modified_base (65)..(65): 2'-deoxy-2'-fluoroguanosine
  modified_base (68)..(68): 2'-deoxy-2'-fluoroguanosine
  modified_base (71)..(71): 2'-deoxy-2'-fluorocytidine
  modified_base (74)..(74): 2'-deoxy-2'-fluorocytidine
  modified_base (77)..(77): 2'-deoxy-2'-fluorocytidine
  modified_base (80)..(80): 2'-deoxy-2'-fluorocytidine
  modified_base (83)..(83): 2'-deoxy-2'-fluorocytidine
  modified_base (86)..(86): 2'-deoxy-2'-fluorocytidine
  modified_base (89)..(89): 2'-O-methoxyethyluridine
  modified_base (90)..(90): 2'-O-methoxyethylguanosine
  modified_base (91)..(91): 2'-O-methoxyethyladenosine

SEQ ID NO: 413 - DNA, 88 bp, Artificial Sequence
  E127
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaagguggcgacuauaaggacgacgacgacaaacaccaccaccaccaccactga

SEQ ID NO: 414 - DNA, 88 bp, Artificial Sequence; identical to SEQ ID NO: 413
  E128
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (13)..(13): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 415 - DNA, 88 bp, Artificial Sequence; identical to SEQ ID NO: 413
  E129
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (13)..(13): 2'-O-methylguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 416 - DNA, 88 bp, Artificial Sequence; identical to SEQ ID NO: 413
  E130
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 417 - DNA, 88 bp, Artificial Sequence; identical to SEQ ID NO: 413
  E131
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (12)..(12): 2'-deoxy-2'-fluorouridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 418 - DNA, 88 bp, Artificial Sequence; identical to SEQ ID NO: 413
  E132
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (12)..(12): 2'-deoxy-2'-fluorouridine
  modified_base (13)..(13): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 419 - DNA, 88 bp, Artificial Sequence; identical to SEQ ID NO: 413
  E133
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (12)..(12): 2'-deoxy-2'-fluorouridine
  modified_base (13)..(13): 2'-O-methylguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 420 - DNA, 88 bp, Artificial Sequence; identical to SEQ ID NO: 413
  E134
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (12)..(12): 2'-deoxy-2'-fluorouridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 421 - DNA, 88 bp, Artificial Sequence
  E135
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccatggacuauaaagacgacgacgauaaagguggcgacuauaaggacgacgacgacaaacaccaccaccaccaccactga

SEQ ID NO: 422 - DNA, 88 bp, Artificial Sequence; identical to SEQ ID NO: 421
  E136
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (13)..(13): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 423 - DNA, 88 bp, Artificial Sequence; identical to SEQ ID NO: 421
  E137
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (13)..(13): 2'-O-methylguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 424 - DNA, 88 bp, Artificial Sequence; identical to SEQ ID NO: 421
  E138
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (11)..(11): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 425 - DNA, 88 bp, Artificial Sequence
  E139
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaaggcggcgacuauaaggacgacgacgacaaacaccaccaccaccaccactga

SEQ ID NO: 426 - DNA, 88 bp, Artificial Sequence; identical to SEQ ID NO: 425
  E140
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (41)..(41): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 427 - DNA, 88 bp, Artificial Sequence; identical to SEQ ID NO: 425
  E141
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (40)..(40): 2'-deoxy-2'-fluorocytidine
  modified_base (41)..(41): 2'-deoxy-2'-fluoroguanosine
  modified_base (43)..(43): 2'-deoxy-2'-fluorocytidine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 428 - DNA, 88 bp, Artificial Sequence; identical to SEQ ID NO: 425
  E142
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (40)..(40): 2'-O-methylcytidine
  modified_base (41)..(41): 2'-deoxy-2'-fluoroguanosine
  modified_base (43)..(43): 2'-O-methylcytidine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 429 - DNA, 88 bp, Artificial Sequence; identical to SEQ ID NO: 425
  E143
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (41)..(41): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 430 - DNA, 88 bp, Artificial Sequence; identical to SEQ ID NO: 425
  E144
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (39)..(39): 2'-deoxy-2'-fluoroguanosine
  modified_base (41)..(41): 2'-deoxy-2'-fluoroguanosine
  modified_base (42)..(42): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 431 - DNA, 88 bp, Artificial Sequence; identical to SEQ ID NO: 425
  E145
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (39)..(39): 2'-deoxy-2'-fluoroguanosine
  modified_base (40)..(40): 2'-deoxy-2'-fluorocytidine
  modified_base (41)..(41): 2'-deoxy-2'-fluoroguanosine
  modified_base (42)..(42): 2'-deoxy-2'-fluoroguanosine
  modified_base (43)..(43): 2'-deoxy-2'-fluorocytidine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 432 - DNA, 88 bp, Artificial Sequence; identical to SEQ ID NO: 425
  E146
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (41)..(41): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 433 - DNA, 88 bp, Artificial Sequence
  E147
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaagguggugacuauaaggacgacgacgacaaacaccaccaccaccaccactga

SEQ ID NO: 434 - DNA, 88 bp, Artificial Sequence; identical to SEQ ID NO: 433
  E148
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (41)..(41): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 435 - DNA, 88 bp, Artificial Sequence; identical to SEQ ID NO: 433
  E149
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (40)..(40): 2'-O-methyluridine
  modified_base (41)..(41): 2'-deoxy-2'-fluoroguanosine
  modified_base (43)..(43): 2'-O-methyluridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 436 - DNA, 88 bp, Artificial Sequence
  E150
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  misc_feature (40)..(40): LNA
  modified_base (41)..(41): 2'-deoxy-2'-fluoroguanosine
  misc_feature (43)..(43): LNA
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaaggtggtgacuauaaggacgacgacgacaaacaccaccaccaccaccactga

SEQ ID NO: 437 - DNA, 88 bp, Artificial Sequence; identical to SEQ ID NO: 433
  E151
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (39)..(39): 2'-deoxy-2'-fluoroguanosine
  modified_base (41)..(41): 2'-deoxy-2'-fluoroguanosine
  modified_base (42)..(42): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 438 - DNA, 88 bp, Artificial Sequence; identical to SEQ ID NO: 433
  E152
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (39)..(39): 2'-deoxy-2'-fluoroguanosine
  modified_base (40)..(40): 2'-O-methyluridine
  modified_base (41)..(41): 2'-deoxy-2'-fluoroguanosine
  modified_base (42)..(42): 2'-deoxy-2'-fluoroguanosine
  modified_base (43)..(43): 2'-O-methyluridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 439 - DNA, 88 bp, Artificial Sequence; identical to SEQ ID NO: 433
  E153
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (38)..(38): 2'-deoxy-2'-fluoroguanosine
  modified_base (41)..(41): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 440 - DNA, 88 bp, Artificial Sequence; identical to SEQ ID NO: 413
  E154
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (68)..(68): 2'-deoxy-2'-fluorocytidine
  modified_base (71)..(71): 2'-deoxy-2'-fluorocytidine
  modified_base (74)..(74): 2'-deoxy-2'-fluorocytidine
  modified_base (77)..(77): 2'-deoxy-2'-fluorocytidine
  modified_base (80)..(80): 2'-deoxy-2'-fluorocytidine
  modified_base (83)..(83): 2'-deoxy-2'-fluorocytidine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 441 - DNA, 88 bp, Artificial Sequence
  E155
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaagguggcgacuauaaggacgacgacgacaaacaucaucaucaucaucautga

SEQ ID NO: 442 - DNA, 88 bp, Artificial Sequence; identical to SEQ ID NO: 441
  E156
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (68)..(68): 2'-deoxy-2'-fluorocytidine
  modified_base (71)..(71): 2'-deoxy-2'-fluorocytidine
  modified_base (74)..(74): 2'-deoxy-2'-fluorocytidine
  modified_base (77)..(77): 2'-deoxy-2'-fluorocytidine
  modified_base (80)..(80): 2'-deoxy-2'-fluorocytidine
  modified_base (83)..(83): 2'-deoxy-2'-fluorocytidine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 443 - DNA, 88 bp, Artificial Sequence; identical to SEQ ID NO: 413
  E157
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 444 - DNA, 88 bp, Artificial Sequence; identical to SEQ ID NO: 413
  E158
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroguanosine
  modified_base (46)..(46): 2'-deoxy-2'-fluorocytidine
  modified_base (53)..(53): 2'-deoxy-2'-fluoroguanosine
  modified_base (55)..(55): 2'-deoxy-2'-fluorocytidine
  modified_base (56)..(56): 2'-deoxy-2'-fluoroguanosine
  modified_base (58)..(58): 2'-deoxy-2'-fluorocytidine
  modified_base (59)..(59): 2'-deoxy-2'-fluoroguanosine
  modified_base (61)..(61): 2'-deoxy-2'-fluorocytidine
  modified_base (62)..(62): 2'-deoxy-2'-fluoroguanosine
  modified_base (64)..(64): 2'-deoxy-2'-fluorocytidine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 445 - DNA, 88 bp, Artificial Sequence; identical to SEQ ID NO: 413
  E159
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroguanosine
  modified_base (45)..(45): 2'-deoxy-2'-fluoroadenosine
  modified_base (53)..(53): 2'-deoxy-2'-fluoroguanosine
  modified_base (54)..(54): 2'-deoxy-2'-fluoroadenosine
  modified_base (56)..(56): 2'-deoxy-2'-fluoroguanosine
  modified_base (57)..(57): 2'-deoxy-2'-fluoroadenosine
  modified_base (59)..(59): 2'-deoxy-2'-fluoroguanosine
  modified_base (60)..(60): 2'-deoxy-2'-fluoroadenosine
  modified_base (62)..(62): 2'-deoxy-2'-fluoroguanosine
  modified_base (63)..(63): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 446 - DNA, 88 bp, Artificial Sequence
  E160
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaagguggcgauuauaaggaugaugaugauaaacaccaccaccaccaccactga

SEQ ID NO: 447 - DNA, 88 bp, Artificial Sequence; identical to SEQ ID NO: 446
  E161
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 448 - DNA, 88 bp, Artificial Sequence; identical to SEQ ID NO: 446
  E162
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (55)..(55): 2'-O-methyluridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 449 - DNA, 88 bp, Artificial Sequence
  E163
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (55)..(55): 2'-O-methoxyethylthymine
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaagguggcgauuauaaggatgaugaugauaaacaccaccaccaccaccactga

SEQ ID NO: 450 - DNA, 88 bp, Artificial Sequence; identical to SEQ ID NO: 449
  E164
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  misc_feature (55)..(55): LNA
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 451 - DNA, 88 bp, Artificial Sequence; identical to SEQ ID NO: 446
  E165
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (54)..(54): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 452 - DNA, 88 bp, Artificial Sequence; identical to SEQ ID NO: 446
  E166
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (54)..(54): 2'-deoxy-2'-fluoroadenosine
  modified_base (55)..(55): 2'-O-methyluridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 453 - DNA, 88 bp, Artificial Sequence; identical to SEQ ID NO: 446
  E167
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 454 - DNA, 88 bp, Artificial Sequence; identical to SEQ ID NO: 446
  E168
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (56)..(56): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 455 - DNA, 88 bp, Artificial Sequence; identical to SEQ ID NO: 446
  E169
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (55)..(55): 2'-O-methyluridine
  modified_base (56)..(56): 2'-deoxy-2'-fluoroguanosine
  modified_base (58)..(58): 2'-O-methyluridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 456 - DNA, 88 bp, Artificial Sequence
  E170
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  misc_feature (55)..(55): LNA
  modified_base (56)..(56): 2'-deoxy-2'-fluoroguanosine
  misc_feature (58)..(58): LNA
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaagguggcgauuauaaggatgatgaugauaaacaccaccaccaccaccactga

SEQ ID NO: 457 - DNA, 88 bp, Artificial Sequence; identical to SEQ ID NO: 446
  E171
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (54)..(54): 2'-deoxy-2'-fluoroadenosine
  modified_base (56)..(56): 2'-deoxy-2'-fluoroguanosine
  modified_base (57)..(57): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 458 - DNA, 88 bp, Artificial Sequence; identical to SEQ ID NO: 446
  E172
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (54)..(54): 2'-deoxy-2'-fluoroadenosine
  modified_base (55)..(55): 2'-O-methyluridine
  modified_base (56)..(56): 2'-deoxy-2'-fluoroguanosine
  modified_base (57)..(57): 2'-deoxy-2'-fluoroadenosine
  modified_base (58)..(58): 2'-O-methyluridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 459 - DNA, 88 bp, Artificial Sequence; identical to SEQ ID NO: 446
  E173
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (53)..(53): 2'-deoxy-2'-fluoroguanosine
  modified_base (56)..(56): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 460 - DNA, 88 bp, Artificial Sequence; identical to SEQ ID NO: 446
  E174
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroguanosine
  modified_base (53)..(53): 2'-deoxy-2'-fluoroguanosine
  modified_base (56)..(56): 2'-deoxy-2'-fluoroguanosine
  modified_base (59)..(59): 2'-deoxy-2'-fluoroguanosine
  modified_base (62)..(62): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 461 - DNA, 88 bp, Artificial Sequence; identical to SEQ ID NO: 446
  E175
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroguanosine
  modified_base (45)..(45): 2'-deoxy-2'-fluoroadenosine
  modified_base (53)..(53): 2'-deoxy-2'-fluoroguanosine
  modified_base (54)..(54): 2'-deoxy-2'-fluoroadenosine
  modified_base (56)..(56): 2'-deoxy-2'-fluoroguanosine
  modified_base (57)..(57): 2'-deoxy-2'-fluoroadenosine
  modified_base (59)..(59): 2'-deoxy-2'-fluoroguanosine
  modified_base (60)..(60): 2'-deoxy-2'-fluoroadenosine
  modified_base (62)..(62): 2'-deoxy-2'-fluoroguanosine
  modified_base (63)..(63): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 462 - DNA, 88 bp, Artificial Sequence; identical to SEQ ID NO: 446
  E176
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (56)..(56): 2'-deoxy-2'-fluoroguanosine
  modified_base (57)..(57): 2'-deoxy-2'-fluoroadenosine
  modified_base (58)..(58): 2'-O-methyluridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 463 - DNA, 88 bp, Artificial Sequence; identical to SEQ ID NO: 446
  E177
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (56)..(56): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 464 - DNA, 88 bp, Artificial Sequence; identical to SEQ ID NO: 413
  E178
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (47)..(47): 2'-deoxy-2'-fluorouridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 465 - DNA, 88 bp, Artificial Sequence; identical to SEQ ID NO: 413
  E179
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (47)..(47): 2'-deoxy-2'-fluorouridine
  modified_base (49)..(49): 2'-O-methyluridine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 466 - DNA, 88 bp, Artificial Sequence
  E180
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (47)..(47): 2'-deoxy-2'-fluorouridine
  misc_feature (49)..(49): LNA
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaagguggcgacuataaggacgacgacgacaaacaccaccaccaccaccactga

SEQ ID NO: 467 - DNA, 88 bp, Artificial Sequence; identical to SEQ ID NO: 413
  E181
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (47)..(47): 2'-deoxy-2'-fluorouridine
  modified_base (48)..(48): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 468 - DNA, 88 bp, Artificial Sequence
  E182
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine
gggagccaccauggacuauaaagacgacgacgauaaagguggcgacuauaaggacgacgacgacaagcaccaccaccaccaccactga

SEQ ID NO: 469 - DNA, 88 bp, Artificial Sequence; identical to SEQ ID NO: 468
  E183
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (50)..(50): 2'-deoxy-2'-fluoroadenosine
  modified_base (65)..(65): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 470 - DNA, 88 bp, Artificial Sequence; identical to SEQ ID NO: 468
  E184
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (50)..(50): 2'-deoxy-2'-fluoroadenosine
  modified_base (52)..(52): 2'-O-methylguanosine
  modified_base (65)..(65): 2'-deoxy-2'-fluoroadenosine
  modified_base (67)..(67): 2'-O-methylguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 471 - DNA, 88 bp, Artificial Sequence; identical to SEQ ID NO: 468
  E185
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (50)..(50): 2'-deoxy-2'-fluoroadenosine
  misc_feature (52)..(52): LNA
  modified_base (65)..(65): 2'-deoxy-2'-fluoroadenosine
  misc_feature (67)..(67): LNA
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 472 - DNA, 88 bp, Artificial Sequence; identical to SEQ ID NO: 468
  E186
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (50)..(50): 2'-deoxy-2'-fluoroadenosine
  modified_base (51)..(51): 2'-deoxy-2'-fluoroadenosine
  modified_base (65)..(65): 2'-deoxy-2'-fluoroadenosine
  modified_base (66)..(66): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 473 - DNA, 67 bp, Artificial Sequence
  E187
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (46)..(46): 2'-deoxy-2'-fluorocytidine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcagccaccaccaccaccaccactga

SEQ ID NO: 474 - DNA, 67 bp, Artificial Sequence; identical to SEQ ID NO: 473
  E188
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (46)..(46): 2'-O-methylcytidine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 475 - DNA, 67 bp, Artificial Sequence; identical to SEQ ID NO: 473
  E189
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 476 - DNA, 67 bp, Artificial Sequence; identical to SEQ ID NO: 473
  E190
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 477 - DNA, 67 bp, Artificial Sequence; identical to SEQ ID NO: 473
  E191
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (45)..(45): 2'-deoxy-2'-fluoroguanosine
  modified_base (46)..(46): 2'-deoxy-2'-fluorocytidine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 478 - DNA, 67 bp, Artificial Sequence; identical to SEQ ID NO: 473
  E192
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (45)..(45): 2'-deoxy-2'-fluoroguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 479 - DNA, 67 bp, Artificial Sequence; identical to SEQ ID NO: 473
  E193
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 480 - DNA, 67 bp, Artificial Sequence
  E194
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcagucaccaccaccaccaccactga

SEQ ID NO: 481 - DNA, 67 bp, Artificial Sequence; identical to SEQ ID NO: 480
  E195
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (46)..(46): 2'-deoxy-2'-fluorouridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 482 - DNA, 67 bp, Artificial Sequence; identical to SEQ ID NO: 480
  E196
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (46)..(46): 2'-O-methyluridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 483 - DNA, 67 bp, Artificial Sequence
  E197
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcagtcaccaccaccaccaccactga

SEQ ID NO: 484 - DNA, 67 bp, Artificial Sequence; identical to SEQ ID NO: 480
  E198
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 485 - DNA, 67 bp, Artificial Sequence; identical to SEQ ID NO: 480
  E199
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (45)..(45): 2'-deoxy-2'-fluoroguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 486 - DNA, 67 bp, Artificial Sequence
  E200
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcuggcaccaccaccaccaccactga

SEQ ID NO: 487 - DNA, 67 bp, Artificial Sequence; identical to SEQ ID NO: 486
  E201
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (46)..(46): 2'-deoxy-2'-fluoroguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 488 - DNA, 67 bp, Artificial Sequence; identical to SEQ ID NO: 486
  E202
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (46)..(46): 2'-O-methylguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 489 - DNA, 67 bp, Artificial Sequence; identical to SEQ ID NO: 486
  E203
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 490 - DNA, 67 bp, Artificial Sequence; identical to SEQ ID NO: 486
  E204
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (45)..(45): 2'-deoxy-2'-fluoroguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 491 - DNA, 67 bp, Artificial Sequence
  E205
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcugucaccaccaccaccaccactga

SEQ ID NO: 492 - DNA, 67 bp, Artificial Sequence; identical to SEQ ID NO: 491
  E206
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (46)..(46): 2'-deoxy-2'-fluorouridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 493 - DNA, 67 bp, Artificial Sequence; identical to SEQ ID NO: 491
  E207
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (46)..(46): 2'-O-methyluridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 494 - DNA, 67 bp, Artificial Sequence; identical to SEQ ID NO: 491
  E208
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 495 - DNA, 67 bp, Artificial Sequence; identical to SEQ ID NO: 491
  E209
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (45)..(45): 2'-deoxy-2'-fluoroguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 496 - DNA, 67 bp, Artificial Sequence
  E210
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcugccaccaccaccaccaccactga

SEQ ID NO: 497 - DNA, 67 bp, Artificial Sequence; identical to SEQ ID NO: 496
  E211
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (46)..(46): 2'-deoxy-2'-fluorocytidine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 498 - DNA, 67 bp, Artificial Sequence; identical to SEQ ID NO: 496
  E212
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (46)..(46): 2'-O-methylcytidine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 499 - DNA, 67 bp, Artificial Sequence; identical to SEQ ID NO: 496
  E213
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 500 - DNA, 67 bp, Artificial Sequence; identical to SEQ ID NO: 496
  E214
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluorouridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 501 - DNA, 67 bp, Artificial Sequence
  E215
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcauccaccaccaccaccaccactga

SEQ ID NO: 502 - DNA, 67 bp, Artificial Sequence; identical to SEQ ID NO: 501
  E216
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (46)..(46): 2'-deoxy-2'-fluorocytidine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 503 - DNA, 67 bp, Artificial Sequence; identical to SEQ ID NO: 501
  E217
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (46)..(46): 2'-O-methylcytidine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 504 - DNA, 67 bp, Artificial Sequence; identical to SEQ ID NO: 501
  E218
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 505 - DNA, 67 bp, Artificial Sequence; identical to SEQ ID NO: 501
  E219
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 506 - DNA, 67 bp, Artificial Sequence; identical to SEQ ID NO: 501
  E220
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (45)..(45): 2'-deoxy-2'-fluorouridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 507 - DNA, 67 bp, Artificial Sequence
  E221
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcauucaccaccaccaccaccactga

SEQ ID NO: 508 - DNA, 67 bp, Artificial Sequence; identical to SEQ ID NO: 507
  E222
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (46)..(46): 2'-deoxy-2'-fluorouridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 509 - DNA, 67 bp, Artificial Sequence; identical to SEQ ID NO: 507
  E223
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (46)..(46): 2'-O-methyluridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 510 - DNA, 67 bp, Artificial Sequence
  E224
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcautcaccaccaccaccaccactga

SEQ ID NO: 511 - DNA, 67 bp, Artificial Sequence; identical to SEQ ID NO: 507
  E225
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 512 - DNA, 67 bp, Artificial Sequence; identical to SEQ ID NO: 507
  E226
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (45)..(45): 2'-deoxy-2'-fluorouridine
  modified_base (46)..(46): 2'-O-methyluridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 513 - DNA, 67 bp, Artificial Sequence; identical to SEQ ID NO: 507
  E227
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (45)..(45): 2'-deoxy-2'-fluorouridine
  modified_base (65)..(65): 2'-O-methoxyethylthymine
  modified_base (66)..(66): 2'-O-methoxyethylguanosine
  modified_base (67)..(67): 2'-O-methoxyethyladenosine

SEQ ID NO: 514 - DNA, 67 bp, Artificial Sequence
  E228
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (44)..(44): 2'-deoxy-2'-fluoroadenosine
  modified_base (65)..(65): 2'-O-methoxyethylthymine
  modified_base (66)..(66): 2'-O-methoxyethylguanosine
  modified_base (67)..(67): 2'-O-methoxyethyladenosine
gggagccaccauggacuauaaggacgacgacgacaaagguggcatucaccaccaccaccaccactga

SEQ ID NO: 515 - DNA, 88 bp, Artificial Sequence; identical to SEQ ID NO: 413
  E229
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (14)..(14): 2'-deoxy-2'-fluoroguanosine
  modified_base (15)..(15): 2'-deoxy-2'-fluoroadenosine
  modified_base (23)..(23): 2'-deoxy-2'-fluoroguanosine
  modified_base (24)..(24): 2'-deoxy-2'-fluoroadenosine
  modified_base (26)..(26): 2'-deoxy-2'-fluoroguanosine
  modified_base (27)..(27): 2'-deoxy-2'-fluoroadenosine
  modified_base (29)..(29): 2'-deoxy-2'-fluoroguanosine
  modified_base (30)..(30): 2'-deoxy-2'-fluoroadenosine
  modified_base (44)..(44): 2'-deoxy-2'-fluoroguanosine
  modified_base (45)..(45): 2'-deoxy-2'-fluoroadenosine
  modified_base (53)..(53): 2'-deoxy-2'-fluoroguanosine
  modified_base (54)..(54): 2'-deoxy-2'-fluoroadenosine
  modified_base (56)..(56): 2'-deoxy-2'-fluoroguanosine
  modified_base (57)..(57): 2'-deoxy-2'-fluoroadenosine
  modified_base (59)..(59): 2'-deoxy-2'-fluoroguanosine
  modified_base (60)..(60): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 516 - DNA, 88 bp, Artificial Sequence; identical to SEQ ID NO: 413
  E230
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (14)..(14): 2'-deoxy-2'-fluoroguanosine
  modified_base (29)..(29): 2'-deoxy-2'-fluoroguanosine
  modified_base (30)..(30): 2'-deoxy-2'-fluoroadenosine
  modified_base (44)..(44): 2'-deoxy-2'-fluoroguanosine
  modified_base (45)..(45): 2'-deoxy-2'-fluoroadenosine
  modified_base (59)..(59): 2'-deoxy-2'-fluoroguanosine
  modified_base (62)..(62): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 517 - DNA, 88 bp, Artificial Sequence; identical to SEQ ID NO: 413
  E231
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (23)..(23): 2'-deoxy-2'-fluoroguanosine
  modified_base (24)..(24): 2'-deoxy-2'-fluoroadenosine
  modified_base (26)..(26): 2'-deoxy-2'-fluoroguanosine
  modified_base (27)..(27): 2'-deoxy-2'-fluoroadenosine
  modified_base (53)..(53): 2'-deoxy-2'-fluoroguanosine
  modified_base (54)..(54): 2'-deoxy-2'-fluoroadenosine
  modified_base (56)..(56): 2'-deoxy-2'-fluoroguanosine
  modified_base (57)..(57): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 518 - DNA, 88 bp, Artificial Sequence; identical to SEQ ID NO: 413
  E232
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (15)..(15): 2'-deoxy-2'-fluoroadenosine
  modified_base (24)..(24): 2'-deoxy-2'-fluoroadenosine
  modified_base (27)..(27): 2'-deoxy-2'-fluoroadenosine
  modified_base (30)..(30): 2'-deoxy-2'-fluoroadenosine
  modified_base (45)..(45): 2'-deoxy-2'-fluoroadenosine
  modified_base (54)..(54): 2'-deoxy-2'-fluoroadenosine
  modified_base (57)..(57): 2'-deoxy-2'-fluoroadenosine
  modified_base (60)..(60): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 519 - DNA, 88 bp, Artificial Sequence; identical to SEQ ID NO: 413
  E233
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (15)..(15): 2'-deoxy-2'-fluoroadenosine
  modified_base (30)..(30): 2'-deoxy-2'-fluoroadenosine
  modified_base (44)..(44): 2'-deoxy-2'-fluoroguanosine
  modified_base (60)..(60): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 520 - DNA, 88 bp, Artificial Sequence; identical to SEQ ID NO: 413
  E234
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (24)..(24): 2'-deoxy-2'-fluoroadenosine
  modified_base (27)..(27): 2'-deoxy-2'-fluoroadenosine
  modified_base (54)..(54): 2'-deoxy-2'-fluoroadenosine
  modified_base (57)..(57): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 521 - DNA, 88 bp, Artificial Sequence; identical to SEQ ID NO: 413
  E235
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (54)..(54): 2'-deoxy-2'-fluoroadenosine
  modified_base (57)..(57): 2'-deoxy-2'-fluoroadenosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 522 - DNA, 88 bp, Artificial Sequence; identical to SEQ ID NO: 413
  E236
  modified_base (1)..(1): 2'-O-methoxyethylguanosine
  modified_base (2)..(2): 2'-O-methoxyethylguanosine
  modified_base (3)..(3): 2'-O-methoxyethylguanosine
  misc_feature (54)..(54): LNA
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 523 - DNA, 88 bp, Artificial Sequence; identical to SEQ ID NO: 413
  E237
  modified_base (1)..(1): 2'-O-methoxyethylguanosine
  modified_base (2)..(2): 2'-O-methoxyethylguanosine
  modified_base (3)..(3): 2'-O-methoxyethylguanosine
  misc_feature (54)..(54): LNA
  misc_feature (57)..(57): LNA
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 524 - DNA, 88 bp, Artificial Sequence; identical to SEQ ID NO: 413
  E238
  modified_base (1)..(1): 2'-O-methoxyethylguanosine
  modified_base (2)..(2): 2'-O-methoxyethylguanosine
  modified_base (3)..(3): 2'-O-methoxyethylguanosine
  misc_feature (53)..(54): 5'-phosphonothioate
  modified_base (53)..(53): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 525 - DNA, 88 bp, Artificial Sequence; identical to SEQ ID NO: 413
  E239
  modified_base (1)..(1): 2'-O-methoxyethylguanosine
  modified_base (2)..(2): 2'-O-methoxyethylguanosine
  modified_base (3)..(3): 2'-O-methoxyethylguanosine
  misc_feature (53)..(54): 5'-phosphonothioate
  modified_base (53)..(53): 2'-deoxy-2'-fluoroguanosine
  misc_feature (56)..(57): 5'-phosphonothioate
  modified_base (56)..(56): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 526 - DNA, 88 bp, Artificial Sequence; identical to SEQ ID NO: 413
  E240
  modified_base (1)..(1): 2'-O-methoxyethylguanosine
  modified_base (2)..(2): 2'-O-methoxyethylguanosine
  modified_base (3)..(3): 2'-O-methoxyethylguanosine
  misc_feature (14)..(15): 5'-phosphonothioate
  modified_base (14)..(14): 2'-deoxy-2'-fluoroguanosine
  misc_feature (23)..(24): 5'-phosphonothioate
  modified_base (23)..(23): 2'-deoxy-2'-fluoroguanosine
  misc_feature (26)..(27): 5'-phosphonothioate
  modified_base (26)..(26): 2'-deoxy-2'-fluoroguanosine
  misc_feature (29)..(30): 5'-phosphonothioate
  modified_base (29)..(29): 2'-deoxy-2'-fluoroguanosine
  misc_feature (44)..(45): 5'-phosphonothioate
  modified_base (44)..(44): 2'-deoxy-2'-fluoroguanosine
  misc_feature (53)..(54): 5'-phosphonothioate
  modified_base (53)..(53): 2'-deoxy-2'-fluoroguanosine
  misc_feature (56)..(57): 5'-phosphonothioate
  modified_base (56)..(56): 2'-deoxy-2'-fluoroguanosine
  misc_feature (59)..(60): 5'-phosphonothioate
  modified_base (59)..(59): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 527 - DNA, 88 bp, Artificial Sequence; identical to SEQ ID NO: 413
  E241
  modified_base (1)..(1): 2'-O-methoxyethylguanosine
  modified_base (2)..(2): 2'-O-methoxyethylguanosine
  modified_base (3)..(3): 2'-O-methoxyethylguanosine
  misc_feature (14)..(15): 5'-phosphonothioate
  modified_base (14)..(14): 2'-deoxy-2'-fluoroguanosine
  misc_feature (29)..(30): 5'-phosphonothioate
  modified_base (29)..(29): 2'-deoxy-2'-fluoroguanosine
  misc_feature (44)..(45): 5'-phosphonothioate
  modified_base (44)..(44): 2'-deoxy-2'-fluoroguanosine
  misc_feature (59)..(60): 5'-phosphonothioate
  modified_base (59)..(59): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 528 - DNA, 88 bp, Artificial Sequence; identical to SEQ ID NO: 413
  E242
  modified_base (1)..(1): 2'-O-methoxyethylguanosine
  modified_base (2)..(2): 2'-O-methoxyethylguanosine
  modified_base (3)..(3): 2'-O-methoxyethylguanosine
  misc_feature (23)..(24): 5'-phosphonothioate
  modified_base (23)..(23): 2'-deoxy-2'-fluoroguanosine
  misc_feature (26)..(27): 5'-phosphonothioate
  modified_base (26)..(26): 2'-deoxy-2'-fluoroguanosine
  misc_feature (53)..(54): 5'-phosphonothioate
  modified_base (53)..(53): 2'-deoxy-2'-fluoroguanosine
  misc_feature (56)..(57): 5'-phosphonothioate
  modified_base (56)..(56): 2'-deoxy-2'-fluoroguanosine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 529 - DNA, 88 bp, Artificial Sequence; identical to SEQ ID NO: 413
  E243
  modified_base (1)..(1): 2'-O-methoxyethylguanosine
  modified_base (2)..(2): 2'-O-methoxyethylguanosine
  modified_base (3)..(3): 2'-O-methoxyethylguanosine
  misc_feature (68)..(69): 5'-phosphonothioate
  modified_base (68)..(68): 2'-deoxy-2'-fluorocytidine
  misc_feature (71)..(72): 5'-phosphonothioate
  modified_base (71)..(71): 2'-deoxy-2'-fluorocytidine
  misc_feature (74)..(75): 5'-phosphonothioate
  modified_base (74)..(74): 2'-deoxy-2'-fluorocytidine
  misc_feature (77)..(78): 5'-phosphonothioate
  modified_base (77)..(77): 2'-deoxy-2'-fluorocytidine
  misc_feature (80)..(81): 5'-phosphonothioate
  modified_base (80)..(80): 2'-deoxy-2'-fluorocytidine
  misc_feature (83)..(84): 5'-phosphonothioate
  modified_base (83)..(83): 2'-deoxy-2'-fluorocytidine
  modified_base (86)..(86): 2'-O-methoxyethylthymine
  modified_base (87)..(87): 2'-O-methoxyethylguanosine
  modified_base (88)..(88): 2'-O-methoxyethyladenosine

SEQ ID NO: 530 - RNA, 88 nt, Artificial Sequence; identical to SEQ ID NO: 305
  E244
  modified_base (1)..(1): 2'-O-methylguanosine
  modified_base (2)..(2): 2'-O-methylguanosine
  modified_base (3)..(3): 2'-O-methylguanosine
  misc_feature (11)..(12): 5'-phosphonothioate
  modified_base (11)..(11): 2'-deoxy-2'-fluoroadenosine
  misc_feature (14)..(15): 5'-phosphonothioate
  modified_base (14)..(14): 2'-deoxy-2'-fluoroguanosine
  misc_feature (17)..(18): 5'-phosphonothioate
  modified_base (17)..(17): 2'-deoxy-2'-fluorouridine
  misc_feature (20)..(21): 5'-phosphonothioate
  modified_base (20)..(20): 2'-deoxy-2'-fluoroadenosine
  misc_feature (23)..(24): 5'-phosphonothioate
  modified_base (23)..(23): 2'-deoxy-2'-fluoroguanosine
  misc_feature (26)..(27): 5'-phosphonothioate
  modified_base (26)..(26): 2'-deoxy-2'-fluoroguanosine
  misc_feature (29)..(30): 5'-phosphonothioate
  modified_base (29)..(29): 2'-deoxy-2'-fluoroguanosine
  misc_feature (32)..(33): 5'-phosphonothioate
  modified_base (32)..(32): 2'-deoxy-2'-fluoroguanosine
  misc_feature (35)..(36): 5'-phosphonothioate
  modified_base (35)..(35): 2'-deoxy-2'-fluoroadenosine
  misc_feature (38)..(39): 5'-phosphonothioate
  modified_base (38)..(38): 2'-deoxy-2'-fluoroguanosine
  misc_feature (41)..(42): 5'-phosphonothioate
  modified_base (41)..(41): 2'-deoxy-2'-fluoroguanosine
  misc_feature (44)..(45): 5'-phosphonothioate
  modified_base (44)..(44): 2'-deoxy-2'-fluoroguanosine
  misc_feature (47)..(48): 5'-phosphonothioate
  modified_base (47)..(47): 2'-deoxy-2'-fluorouridine
  misc_feature (50)..(51): 5'-phosphonothioate
  modified_base (50)..(50): 2'-deoxy-2'-fluoroadenosine
  misc_feature (53)..(54): 5'-phosphonothioate
  modified_base (53)..(53): 2'-deoxy-2'-fluoroguanosine
  misc_feature (56)..(57): 5'-phosphonothioate
  modified_base (56)..(56): 2'-deoxy-2'-fluoroguanosine
  misc_feature (59)..(60): 5'-phosphonothioate
  modified_base (59)..(59): 2'-deoxy-2'-fluoroguanosine
  misc_feature (62)..(63): 5'-phosphonothioate
  modified_base (62)..(62): 2'-deoxy-2'-fluoroguanosine
  misc_feature (65)..(66): 5'-phosphonothioate
  modified_base (65)..(65): 2'-deoxy-2'-fluoroadenosine
  misc_feature (68)..(69): 5'-phosphonothioate
  modified_base (68)..(68): 2'-deoxy-2'-fluorocytidine
  misc_feature (71)..(72): 5'-phosphonothioate
  modified_base (71)..(71): 2'-deoxy-2'-fluorocytidine
  misc_feature (74)..(75): 5'-phosphonothioate
  modified_base (74)..(74): 2'-deoxy-2'-fluorocytidine
  misc_feature (77)..(78): 5'-phosphonothioate
  modified_base (77)..(77): 2'-deoxy-2'-fluorocytidine
  misc_feature (80)..(81): 5'-phosphonothioate
  modified_base (80)..(80): 2'-deoxy-2'-fluorocytidine
  misc_feature (83)..(84): 5'-phosphonothioate
  modified_base (83)..(83): 2'-deoxy-2'-fluorocytidine
  modified_base (86)..(86): 2'-O-methyluridine
  modified_base (87)..(87): 2'-O-methylguanosine
  modified_base (88)..(88): 2'-O-methyladenosine

SEQ ID NO: 531 - DNA, 88 bp, Artificial Sequence; identical to SEQ ID NO: 413
  E245
  misc_feature (1)..(2): 5'-phosphonothioate
  modified_base (1)..(1): 2'-O-methoxyethylguanosine
  misc_feature (2)..(3): 5'-phosphonothioate
  modified_base (2)..(2): 2'-O-methoxyethylguanosine
  modified_base (3)..(3): 2'-O-methoxyethylguanosine
  misc_feature (11)..(12): 5'-phosphonothioate
  modified_base (11)..(11): 2'-deoxy-2'-fluoroadenosine
  misc_feature (14)..(15): 5'-phosphonothioate
  modified_base (14)..(14): 2'-deoxy-2'-fluoroguanosine
  misc_feature (17)..(18): 5'-phosphonothioate
  modified_base (17)..(17): 2'-deoxy-2'-fluorouridine
  misc_feature (20)..(21): 5'-phosphonothioate
  modified_base (20)..(20): 2'-deoxy-2'-fluoroadenosine
  misc_feature (23)..(24): 5'-phosphonothioate
  modified_base (23)..(23): 2'-deoxy-2'-fluoroguanosine
  misc_feature (26)..(27): 5'-phosphonothioate
  modified_base (26)..(26): 2'-deoxy-2'-fluoroguanosine
  misc_feature (29)..(30): 5'-phosphonothioate
  modified_base (29)..(29): 2'-deoxy-2'-fluoroguanosine
  misc_feature (32)..(33): 5'-phosphonothioate
  modified_base (32)..(32): 2'-deoxy-2'-fluoroguanosine
  misc_feature (35)..(36): 5'-phosphonothioate
  modified_base (35)..(35): 2'-deoxy-2'-fluoroadenosine
  misc_feature (38)..(39): 5'-phosphonothioate
  modified_base (38)..(38): 2'-deoxy-2'-fluoroguanosine
  misc_feature (41)..(42): 5'-phosphonothioate
  modified_base (41)..(41): 2'-deoxy-2'-fluoroguanosine
  misc_feature (44)..(45): 5'-phosphonothioate
  modified_base (44)..(44): 2'-deoxy-2'-fluoroguanosine
  misc_feature (47)..(48): 5'-phosphonothioate
  modified_base (47)..(47): 2'-deoxy-2'-fluorouridine
  misc_feature (50)..(51): 5'-phosphonothioate
  modified_base (50)..(50): 2'-deoxy-2'-fluoroadenosine
  misc_feature (53)..(54): 5'-phosphonothioate
  modified_base (53)..(53): 2'-deoxy-2'-fluoroguanosine
  misc_feature (56)..(57): 5'-phosphonothioate
  modified_base (56)..(56): 2'-deoxy-2'-fluoroguanosine
  misc_feature (59)..(60): 5'-phosphonothioate
  modified_base (59)..(59): 2'-deoxy-2'-fluoroguanosine
  misc_feature (62)..(63): 5'-phosphonothioate
  modified_base (62)..(62): 2'-deoxy-2'-fluoroguanosine
  misc_feature (65)..(66): 5'-phosphonothioate
  modified_base (65)..(65): 2'-deoxy-2'-fluoroadenosine
  misc_feature (68)..(69): 5'-phosphonothioate
  modified_base (68)..(68): 2'-deoxy-2'-fluorocytidine
  misc_feature (71)..(72): 5'-phosphonothioate
  modified_base (71)..(71): 2'-deoxy-2'-fluorocytidine
  misc_feature (74)..(75): 5'-phosphonothioate
  modified_base (74)..(74): 2'-deoxy-2'-fluorocytidine
  misc_feature (77)..(78): 5'-phosphonothioate
  modified_base (77)..(77): 2'-deoxy-2'-fluorocytidine
  misc_feature (80)..(81): 5'-phosphonothioate
  modified_base (80)..(80): 2'-deoxy-2'-fluorocytidine
  misc_feature (83)..(84): 5'-phosphonothioate
  modified_base (83)..(83): 2'-deoxy-2'-fluorocytidine
  misc_feature (86)..(87): 5'-phosphonothioate
  modified_base (86)..(86): 2'-O-methoxyethylthymine
  misc_feature (87)..(88): 5'-phosphonothioate
  modified_base (87)..(87): 2'-O-methoxyethylguanosine
  modified_base (88)..(88): 2'-O-methoxyethyladenosine

SEQ ID NO: 532 - RNA, 88 nt, Artificial Sequence; identical to SEQ ID NO: 305
  E246
  misc_feature (1)..(2): 5'-phosphonothioate
  modified_base (1)..(1): 2'-O-methylguanosine
  misc_feature (2)..(3): 5'-phosphonothioate
  modified_base (2)..(2): 2'-O-methylguanosine
  misc_feature (3)..(4): 5'-phosphonothioate
  modified_base (3)..(3): 2'-O-methylguanosine
  misc_feature (4)..(5): 5'-phosphonothioate
  modified_base (4)..(4): 2'-O-methyladenosine
  misc_feature (5)..(6): 5'-phosphonothioate
  modified_base (5)..(5): 2'-O-methylguanosine
  misc_feature (6)..(7): 5'-phosphonothioate
  modified_base (6)..(6): 2'-O-methylcytidine
  misc_feature (7)..(8): 5'-phosphonothioate
  modified_base (7)..(7): 2'-O-methylcytidine
  misc_feature (8)..(9): 5'-phosphonothioate
  modified_base (8)..(8): 2'-O-methyladenosine
  misc_feature (9)..(10): 5'-phosphonothioate
  modified_base (9)..(9): 2'-O-methylcytidine
  misc_feature (10)..(11): 5'-phosphonothioate
  modified_base (10)..(10): 2'-O-methylcytidine
  misc_feature (11)..(12): 5'-phosphonothioate
  modified_base (11)..(11): 2'-O-methyladenosine
  misc_feature (12)..(13): 5'-phosphonothioate
  modified_base (12)..(12): 2'-O-methyluridine
  misc_feature (13)..(14): 5'-phosphonothioate
  modified_base (13)..(13): 2'-O-methylguanosine
  misc_feature (14)..(15): 5'-phosphonothioate
  modified_base (14)..(14): 2'-O-methylguanosine
  misc_feature (15)..(16): 5'-phosphonothioate
  modified_base (15)..(15): 2'-O-methyladenosine
  misc_feature (16)..(17): 5'-phosphonothioate
  modified_base (16)..(16): 2'-O-methylcytidine
  misc_feature (17)..(18): 5'-phosphonothioate
  modified_base (17)..(17): 2'-O-methyluridine
  misc_feature (18)..(19): 5'-phosphonothioate
  modified_base (18)..(18): 2'-O-methyladenosine
  misc_feature (19)..(20): 5'-phosphonothioate
  modified_base (19)..(19): 2'-O-methyluridine
  misc_feature (20)..(21): 5'-phosphonothioate
  modified_base (20)..(20): 2'-O-methyladenosine
  misc_feature (21)..(22): 5'-phosphonothioate
  modified_base (21)..(21): 2'-O-methyladenosine
  misc_feature (22)..(23): 5'-phosphonothioate
  modified_base (22)..(22): 2'-O-methyladenosine
  misc_feature (23)..(24): 5'-phosphonothioate
  modified_base (23)..(23): 2'-O-methylguanosine
  misc_feature (24)..(25): 5'-phosphonothioate
  modified_base (24)..(24): 2'-O-methyladenosine
  misc_feature (25)..(26): 5'-phosphonothioate
  modified_base (25)..(25): 2'-O-methylcytidine
  misc_feature (26)..(27): 5'-phosphonothioate
  modified_base (26)..(26): 2'-O-methylguanosine
  misc_feature (27)..(28): 5'-phosphonothioate
  modified_base (27)..(27): 2'-O-methyladenosine
  misc_feature (28)..(29): 5'-phosphonothioate
  modified_base (28)..(28): 2'-O-methylcytidine
  misc_feature (29)..(30): 5'-phosphonothioate
  modified_base (29)..(29): 2'-O-methylguanosine
  misc_feature (30)..(31): 5'-phosphonothioate
  modified_base (30)..(30): 2'-O-methyladenosine
  misc_feature (31)..(32): 5'-phosphonothioate
  modified_base (31)..(31): 2'-O-methylcytidine
  misc_feature (32)..(33): 5'-phosphonothioate
  modified_base (32)..(32): 2'-O-methylguanosine
  misc_feature (33)..(34): 5'-phosphonothioate
  modified_base (33)..(33): 2'-O-methyladenosine
  misc_feature (34)..(35): 5'-phosphonothioate
  modified_base (34)..(34): 2'-O-methyluridine
  misc_feature (35)..(36): 5'-phosphonothioate
  modified_base (35)..(35): 2'-O-methyladenosine
  misc_feature (36)..(37): 5'-phosphonothioate
  modified_base (36)..(36): 2'-O-methyladenosine
  misc_feature (37)..(38): 5'-phosphonothioate
  modified_base (37)..(37): 2'-O-methyladenosine
  misc_feature (38)..(39): 5'-phosphonothioate
  modified_base (38)..(38): 2'-O-methylguanosine
  misc_feature (39)..(40): 5'-phosphonothioate
  modified_base (39)..(39): 2'-O-methylguanosine
  misc_feature (40)..(41): 5'-phosphonothioate
  modified_base (40)..(40): 2'-O-methyluridine
  misc_feature (41)..(42): 5'-phosphonothioate
  modified_base (41)..(41): 2'-O-methylguanosine
  misc_feature (42)..(43): 5'-phosphonothioate
  modified_base (42)..(42): 2'-O-methylguanosine
  misc_feature (43)..(44): 5'-phosphonothioate
  modified_base (43)..(43): 2'-O-methylcytidine
  misc_feature (44)..(45): 5'-phosphonothioate
  modified_base (44)..(44): 2'-O-methylguanosine
  misc_feature (45)..(46): 5'-phosphonothioate
  modified_base (45)..(45): 2'-O-methyladenosine
  misc_feature (46)..(47): 5'-phosphonothioate
  modified_base (46)..(46): 2'-O-methylcytidine
  misc_feature (47)..(48): 5'-phosphonothioate
  modified_base (47)..(47): 2'-O-methyluridine
  misc_feature (48)..(49): 5'-phosphonothioate
  modified_base (48)..(48): 2'-O-methyladenosine
  misc_feature (49)..(50): 5'-phosphonothioate
  modified_base (49)..(49): 2'-O-methyluridine
  misc_feature (50)..(51): 5'-phosphonothioate
  modified_base (50)..(50): 2'-O-methyladenosine
  misc_feature (51)..(52): 5'-phosphonothioate
  modified_base (51)..(51): 2'-O-methyladenosine
  misc_feature (52)..(53): 5'-phosphonothioate
  modified_base (52)..(52): 2'-O-methylguanosine
  misc_feature (53)..(54): 5'-phosphonothioate
  modified_base (53)..(53): 2'-O-methylguanosine
  misc_feature (54)..(55): 5'-phosphonothioate
  modified_base (54)..(54): 2'-O-methyladenosine
  misc_feature (55)..(56): 5'-phosphonothioate
  modified_base (55)..(55): 2'-O-methylcytidine
  misc_feature (56)..(57): 5'-phosphonothioate
  modified_base (56)..(56): 2'-O-methylguanosine
  misc_feature (57)..(58): 5'-phosphonothioate
  modified_base (57)..(57): 2'-O-methyladenosine
  misc_feature (58)..(59): 5'-phosphonothioate
  modified_base (58)..(58): 2'-O-methylcytidine
  misc_feature (59)..(60): 5'-phosphonothioate
  modified_base (59)..(59): 2'-O-methylguanosine
  misc_feature (60)..(61): 5'-phosphonothioate
  modified_base (60)..(60): 2'-O-methyladenosine
  misc_feature (61)..(62): 5'-phosphonothioate
  modified_base (61)..(61): 2'-O-methylcytidine
  misc_feature (62)..(63): 5'-phosphonothioate
  modified_base (62)..(62): 2'-O-methylguanosine
  misc_feature (63)..(64): 5'-phosphonothioate
  modified_base (63)..(63): 2'-O-methyladenosine
  misc_feature (64)..(65): 5'-phosphonothioate
  modified_base (64)..(64): 2'-O-methylcytidine
  misc_feature (65)..(66): 5'-phosphonothioate
  modified_base (65)..(65): 2'-O-methyladenosine
  misc_feature (66)..(67): 5'-phosphonothioate
  modified_base (66)..(66): 2'-O-methyladenosine
  misc_feature (67)..(68): 5'-phosphonothioate
  modified_base (67)..(67): 2'-O-methyladenosine
  misc_feature (68)..(69): 5'-phosphonothioate
  modified_base (68)..(68): 2'-O-methylcytidine
  misc_feature (69)..(70): 5'-phosphonothioate
  modified_base (69)..(69): 2'-O-methyladenosine
  misc_feature (70)..(71): 5'-phosphonothioate
  modified_base (70)..(70): 2'-O-methylcytidine
  misc_feature (71)..(72): 5'-phosphonothioate
  modified_base (71)..(71): 2'-O-methylcytidine
  misc_feature (72)..(73): 5'-phosphonothioate
  modified_base (72)..(72): 2'-O-methyladenosine
  misc_feature (73)..(74): 5'-phosphonothioate
  modified_base (73)..(73): 2'-O-methylcytidine
  misc_feature (74)..(75): 5'-phosphonothioate
  modified_base (74)..(74): 2'-O-methylcytidine
  misc_feature (75)..(76): 5'-phosphonothioate
  modified_base (75)..(75): 2'-O-methyladenosine
  misc_feature (76)..(77): 5'-phosphonothioate
  modified_base (76)..(76): 2'-O-methylcytidine
  misc_feature (77)..(78): 5'-phosphonothioate
  modified_base (77)..(77): 2'-O-methylcytidine
  misc_feature (78)..(79): 5'-phosphonothioate
  modified_base (78)..(78): 2'-O-methyladenosine
  misc_feature (79)..(80): 5'-phosphonothioate
  modified_base (79)..(79): 2'-O-methylcytidine
  misc_feature (80)..(81): 5'-phosphonothioate
  modified_base (80)..(80): 2'-O-methylcytidine
  misc_feature (81)..(82): 5'-phosphonothioate
  modified_base (81)..(81): 2'-O-methyladenosine
  misc_feature (82)..(83): 5'-phosphonothioate
  modified_base (82)..(82): 2'-O-methylcytidine
  misc_feature (83)..(84): 5'-phosphonothioate
  modified_base (83)..(83): 2'-O-methylcytidine
  misc_feature (84)..(85): 5'-phosphonothioate
  modified_base (84)..(84): 2'-O-methyladenosine
  misc_feature (85)..(86): 5'-phosphonothioate
  modified_base (85)..(85): 2'-O-methylcytidine
  misc_feature (86)..(87): 5'-phosphonothioate
  modified_base (86)..(86): 2'-O-methyluridine
  misc_feature (87)..(88): 5'-phosphonothioate
  modified_base (87)..(87): 2'-O-methylguanosine

SEQ ID NO: 533 - RNA, 145 nt, Artificial Sequence; identical to SEQ ID NO: 1
  E247
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine
  misc_feature (143)..(144): 5'-phosphonothioate
  modified_base (143)..(143): 2'-O-methyluridine
  misc_feature (144)..(145): 5'-phosphonothioate
  modified_base (144)..(144): 2'-deoxy-2'-fluoroguanosine
  modified_base (145)..(145): 2'-O-methyladenosine

SEQ ID NO: 534 - RNA, 80 nt, Artificial Sequence; identical to SEQ ID NO: 2
  E247-1
  modified_base (1)..(1): 2'-deoxy-2'-fluoroguanosine
  modified_base (2)..(2): 2'-O-methylguanosine
  modified_base (3)..(3): 2'-deoxy-2'-fluoroguanosine
  modified_base (4)..(4): 2'-O-methyladenosine
  modified_base (5)..(5): 2'-deoxy-2'-fluoroguanosine
  modified_base (6)..(6): 2'-O-methyladenosine

SEQ ID NO: 535 - RNA, 65 nt, Artificial Sequence; identical to SEQ ID NO: 3
  E247-2
  misc_feature (1)..(1): 5'-phosphorylated
  misc_feature (63)..(64): 5'-phosphonothioate
  modified_base (63)..(63): 2'-O-methyluridine
  misc_feature (64)..(65): 5'-phosphonothioate
  modified_base (64)..(64): 2'-deoxy-2'-fluoroguanosine
  modified_base (65)..(65): 2'-O-methyladenosine

SEQ ID NO: 536 - RNA, 145 nt, Artificial Sequence; identical to SEQ ID NO: 1
  E248
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  misc_feature (3)..(4): 5'-phosphonothioate
  modified_base (3)..(3): 2'-deoxy-2'-fluoroguanosine
  misc_feature (4)..(5): 5'-phosphonothioate
  modified_base (4)..(4): 2'-O-methyladenosine
  modified_base (5)..(5): 2'-deoxy-2'-fluoroguanosine
  modified_base (6)..(6): 2'-O-methyladenosine
  modified_base (143)..(143): 2'-O-methyluridine
  modified_base (144)..(144): 2'-deoxy-2'-fluoroguanosine
  modified_base (145)..(145): 2'-O-methyladenosine

SEQ ID NO: 537 - RNA, 80 nt, Artificial Sequence; identical to SEQ ID NO: 2
  E248-1
  misc_feature (1)..(2): 5'-phosphonothioate
  modified_base (1)..(1): 2'-deoxy-2'-fluoroguanosine
  misc_feature (2)..(3): 5'-phosphonothioate
  modified_base (2)..(2): 2'-O-methylguanosine
  misc_feature (3)..(4): 5'-phosphonothioate
  modified_base (3)..(3): 2'-deoxy-2'-fluoroguanosine
  misc_feature (4)..(5): 5'-phosphonothioate
  modified_base (4)..(4): 2'-O-methyladenosine
  modified_base (5)..(5): 2'-deoxy-2'-fluoroguanosine
  modified_base (6)..(6): 2'-O-methyladenosine

SEQ ID NO: 538 - RNA, 65 nt, Artificial Sequence; identical to SEQ ID NO: 3
  E248-1
  misc_feature (1)..(1): 5'-phosphorylated
  modified_base (63)..(63): 2'-O-methyluridine
  modified_base (64)..(64): 2'-deoxy-2'-fluoroguanosine
  modified_base (65)..(65): 2'-O-methyladenosine

SEQ ID NO: 539 - protein, 35 aa, Artificial Sequence
  Polypeptide sample
MDYKDDDDKIIDYKDDDDKGGDYKDDDDKHHHHHH

SEQ ID NO: 540 - protein, 17 aa, Artificial Sequence
  Polypeptide sample
MDYKDDDDKGGHHHHHH

SEQ ID NO: 541 - protein, 25 aa, Artificial Sequence
  Polypeptide sample
MDYKDDDDKGGDYKDDDDKHHHHHH

SEQ ID NO: 542 - protein, 43 aa, Artificial Sequence
  Polypeptide sample
MDYKDDDDKIIDYKDDDDKGGDYKDDDDKSIINFEKLHHHHHH

SEQ ID NO: 543 - DNA, 50 bp, Artificial Sequence
  FW primer
aagctaatacgactcactatagggtgcattggagccttgccttgctgctc

SEQ ID NO: 544 - DNA, 134 bp, Artificial Sequence
  RV primer 1
ctagattttttttttttttttttttttttttttttttttttttttttttttttttttttttttttttttttttttttttttttttttttttttttttttttttttgccgcccactcagactttattcaaagacc

SEQ ID NO: 545 - RNA, 66 nt, Artificial Sequence
  RN-1
gggaaauaagagagaaaagaagaguaagaagaaauauaagagccaccaugaacuuucugcugucuu

SEQ ID NO: 546 - DNA, 767 bp, Artificial Sequence
  GN
ttggaccctcgtacagaagctaatacgactcactatagggaaataagagagaaaagaagagtaagaagaaatataagagccaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgataataggctggagcctcggtggccatgcttcttgccccttgggcctccccccagcccctcctccccttcctgcacccgtacccccgtggtctttgaataaagtctga

SEQ ID NO: 547 - DNA, 30 bp, Artificial Sequence
  Template DNA-A
ggctccaatgcacccaagacagcagaaagt

SEQ ID NO: 548 - DNA, 45 bp, Artificial Sequence
  RV primer 2
gattacgccaagctttggcttgaagatgtactcgatctcatcagg

SEQ ID NO: 549 - DNA, 15 bp, Artificial Sequence
  Sequence primer M13FW
ctcgatctcatcagg

SEQ ID NO: 550 - DNA, 17 bp, Artificial Sequence
  Sequence primer M13RV
caggaaacagctatgac

SEQ ID NO: 551 - RNA, 66 nt, Artificial Sequence; identical to SEQ ID NO: 545
  RN-1

SEQ ID NO: 552 - DNA, 802 bp, Artificial Sequence
  GN'
aattcagtacttaatacgactcactatagggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaat

SEQ ID NO: 553 - DNA, 30 bp, Artificial Sequence; identical to SEQ ID NO: 547
  Template DNA-B

SEQ ID NO: 554 - RNA, 66 nt, Artificial Sequence; identical to SEQ ID NO: 545
  EN-1
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethyladenosine
  modified_base (6)..(6): 2'-O-methoxyethyladenosine
  modified_base (9)..(9): 2'-deoxy-2'-fluoroadenosine
  modified_base (12)..(12): 2'-deoxy-2'-fluoroguanosine
  modified_base (15)..(15): 2'-deoxy-2'-fluoroadenosine
  modified_base (18)..(18): 2'-deoxy-2'-fluoroadenosine
  modified_base (21)..(21): 2'-deoxy-2'-fluoroadenosine
  modified_base (24)..(24): 2'-deoxy-2'-fluoroguanosine
  modified_base (27)..(27): 2'-deoxy-2'-fluoroadenosine
  modified_base (30)..(30): 2'-deoxy-2'-fluoroadenosine
  modified_base (33)..(33): 2'-deoxy-2'-fluoroadenosine
  modified_base (36)..(36): 2'-deoxy-2'-fluoroadenosine
  modified_base (39)..(39): 2'-deoxy-2'-fluoroadenosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluoroadenosine
  modified_base (51)..(51): 2'-deoxy-2'-fluoroadenosine
  modified_base (54)..(54): 2'-deoxy-2'-fluorouridine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine

SEQ ID NO: 555 - DNA, 30 bp, Artificial Sequence; identical to SEQ ID NO: 547
  Template DNA-C

SEQ ID NO: 556 - RNA, 844 nt, Artificial Sequence
  RN and RN'
gggaaauaagagagaaaagaagaguaagaagaaauauaagagccaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcggugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 557 - RNA, 844 nt, Artificial Sequence; identical to SEQ ID NO: 556
  EN
  modified_base (1)..(1): 2'-O-methoxyethylguanosine
  modified_base (2)..(2): 2'-O-methoxyethylguanosine
  modified_base (3)..(3): 2'-O-methoxyethylguanosine
  modified_base (4)..(4): 2'-O-methoxyethyladenosine
  modified_base (5)..(5): 2'-O-methoxyethyladenosine
  modified_base (6)..(6): 2'-O-methoxyethyladenosine
  modified_base (9)..(9): 2'-deoxy-2'-fluoroadenosine
  modified_base (12)..(12): 2'-deoxy-2'-fluoroguanosine
  modified_base (15)..(15): 2'-deoxy-2'-fluoroadenosine
  modified_base (18)..(18): 2'-deoxy-2'-fluoroadenosine
  modified_base (21)..(21): 2'-deoxy-2'-fluoroadenosine
  modified_base (24)..(24): 2'-deoxy-2'-fluoroguanosine
  modified_base (27)..(27): 2'-deoxy-2'-fluoroadenosine
  modified_base (30)..(30): 2'-deoxy-2'-fluoroadenosine
  modified_base (33)..(33): 2'-deoxy-2'-fluoroadenosine
  modified_base (36)..(36): 2'-deoxy-2'-fluoroadenosine
  modified_base (39)..(39): 2'-deoxy-2'-fluoroadenosine
  modified_base (42)..(42): 2'-deoxy-2'-fluoroguanosine
  modified_base (45)..(45): 2'-deoxy-2'-fluoroadenosine
  modified_base (48)..(48): 2'-deoxy-2'-fluoroadenosine
  modified_base (51)..(51): 2'-deoxy-2'-fluoroadenosine
  modified_base (54)..(54): 2'-deoxy-2'-fluorouridine
  modified_base (57)..(57): 2'-deoxy-2'-fluorocytidine
  modified_base (60)..(60): 2'-deoxy-2'-fluorocytidine
  modified_base (63)..(63): 2'-deoxy-2'-fluorouridine

The invention claimed is:

1. A polynucleotide comprising a translated region from a start codon to a stop codon, wherein the translated region contains n codons, and the n is a positive integer of 2 or more, each of the n codons contains first, second and third nucleotides, the first nucleotides in at least two codons of the n codons are sugar modified nucleotides, and the first, second and third nucleotides in the stop codon are sugar modified nucleotides.

2. The polynucleotide according to claim 1, wherein the sugar modified nucleotides each contain a sugar portion modified at least in the 2' position.

3. The polynucleotide according to claim 2, wherein the sugar portion modified at least in the 2' position is selected from the following:

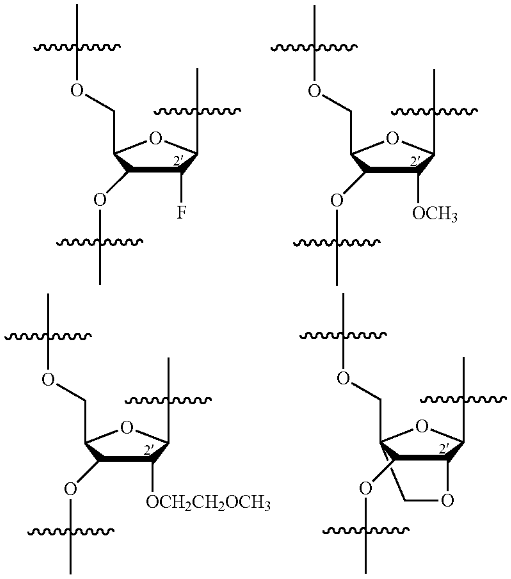

4. The polynucleotide according to claim 1, wherein the sugar modified nucleotides each contain a base portion corresponding to a base selected from the group consisting of adenine, guanine, cytosine, and uracil, and the number of types of the base is at least two.

5. The polynucleotide according to claim 1, wherein at least one of the sugar modified nucleotides contains a modified base portion.

6. The polynucleotide according to claim 1, wherein the first nucleotides in all the n codons are sugar modified nucleotides.

7. The polynucleotide according to claim 1, wherein the first, second and third nucleotides in the start codon are sugar modified nucleotides.

8. The polynucleotide according to claim 1, wherein the second nucleotide in at least one codon of the n codons, in addition to the stop codon, is a sugar modified nucleotide.

9. The polynucleotide according to claim 1, wherein the third nucleotide in at least one codon of the n codons, in addition to the stop codon, is a sugar modified nucleotide.

10. The polynucleotide according to claim 1, wherein the n is an integer of 2 to 2000.

11. The polynucleotide according to claim 1, further comprising a 5' untranslated region.

12. The polynucleotide according to claim 11, wherein the 5' untranslated region contains a base modified nucleotide containing the following base portion:

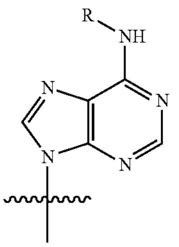

wherein R is an alkyl group having 1 to 6 carbon atoms.

13. The polynucleotide according to claim 11, wherein first, second, and third nucleotides from a 5' end of the 5' untranslated region are sugar modified nucleotides.

14. The polynucleotide according to claim 11, further comprising a 5' cap structure.

15. The polynucleotide according to claim 1, further comprising a 3' untranslated region.

16. The polynucleotide according to claim 15, wherein the 3' untranslated region contains a poly A chain.

17. The polynucleotide according to claim 15, wherein first, second, and third nucleotides from a 3' end of the 3' untranslated region are sugar modified nucleotides.

18. The polynucleotide according to claim 11, wherein the 5' untranslated region contains a sugar modified nucleotide.

19. The polynucleotide according to claim 1, comprising the following structure:

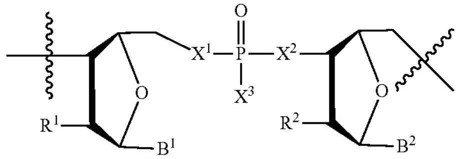

wherein $R^1$ and $R^2$ each independently represent H, OH, F or $OCH_3$, $B^1$ and $B^2$ each independently represent a base portion, $X^1$ represents O, S or NH, and $X^2$ represents O, S, NH or the following structure:

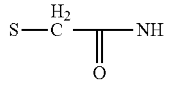

wherein $X^3$ represents OH, SH or a salt thereof, and $X^1$ and $X^2$ are not simultaneously O.

20. The polynucleotide according to claim 1, comprising a phosphorothioate structure.

21. The polynucleotide according to claim 1, wherein the first nucleotide and the second nucleotide in at least one codon of the n codons are linked to each other via phosphorothioate.

22. The polynucleotide according to claim 11, wherein first to second nucleotides, first to third nucleotides, first to fourth nucleotides, or first to fifth nucleotides from the 5' end of the 5' untranslated region are linked to one another via phosphorothioate.

23. The polynucleotide according to claim 15, wherein first to second nucleotides, first to third nucleotides, first to fourth nucleotides, or first to fifth nucleotides from the 3' end of the 3' untranslated region are linked to one another via phosphorothioate.

24. A pharmaceutical composition comprising the polynucleotide according to claim 1.

25. The polynucleotide according to claim 15, wherein the 3' untranslated region contains a sugar modified nucleotide.

* * * * *